US009517261B2

(12) United States Patent
Feederle et al.

(10) Patent No.: US 9,517,261 B2
(45) Date of Patent: Dec. 13, 2016

(54) SECOND GENERATION VIRUS-LIKE PARTICLES (VLP) FROM EPSTEIN-BARR VIRUSES FOR VACCINATION PURPOSES

(71) Applicant: Deutsches Krebsforschungszentrum, Heidelberg (DE)

(72) Inventors: Regina Feederle, Heidelberg (DE); Sophia Hundt, Heidelberg (DE); Henri-Jacques Delecluse, Heidelberg (DE)

(73) Assignee: DEUTSCHES KREBSFORSCHUNGSZENTRUM, Heidelberg (DE)

( * ) Notice: Subject to any disclaimer, the term of this patent is extended or adjusted under 35 U.S.C. 154(b) by 31 days.

(21) Appl. No.: 14/366,645

(22) PCT Filed: Dec. 28, 2012

(86) PCT No.: PCT/EP2012/077007
§ 371 (c)(1),
(2) Date: Jun. 18, 2014

(87) PCT Pub. No.: WO2013/098364
PCT Pub. Date: Jul. 4, 2013

(65) Prior Publication Data
US 2014/0322255 A1 Oct. 30, 2014

(30) Foreign Application Priority Data

Dec. 30, 2011 (EP) .................................... 11196215

(51) Int. Cl.
*A61K 39/245* (2006.01)
*C12N 15/86* (2006.01)
*C12N 7/00* (2006.01)
*A61K 39/00* (2006.01)
*A61K 39/12* (2006.01)
*C07K 14/005* (2006.01)
*C07K 16/08* (2006.01)

(52) U.S. Cl.
CPC ............. *A61K 39/245* (2013.01); *A61K 39/12* (2013.01); *C12N 7/00* (2013.01); *C12N 15/86* (2013.01); *A61K 2039/5258* (2013.01); *C12N 2710/16223* (2013.01); *C12N 2710/16234* (2013.01); *C12N 2710/16242* (2013.01); *C12N 2710/16243* (2013.01); *C12N 2710/16262* (2013.01); *C12N 2800/204* (2013.01)

(58) Field of Classification Search
CPC .................. A61K 39/245; A61K 39/12; A61K 2039/5258; C12N 15/86; C12N 7/00; C12N 2710/16234; C12N 2800/204; C12N 2710/16243; C12N 2710/16242; C12N 2710/16223; C12N 2710/16262; C12N 2710/00041; C12N 2710/16134; C12N 2710/16171; C12N 2710/16634; C12N 2710/20034; C12N 2700/00; C12N 2710/10021; C12N 2710/16734; C07K 14/005; C07K 16/081; C07K 14/05
See application file for complete search history.

(56) References Cited

U.S. PATENT DOCUMENTS

| 9,028,840 B2 * | 5/2015 | Adhikary et al. ......... 424/230.1 |
| 2004/0009469 A1 * | 1/2004 | Apt et al. .................... 435/5 |
| 2007/0087331 A1 * | 4/2007 | Bachmann et al. ............ 435/5 |
| 2008/0044437 A1 * | 2/2008 | Chen ......................... 424/204.1 |
| 2010/0150961 A1 * | 6/2010 | Vedvick ................... C12N 7/00 424/216.1 |
| 2012/0301494 A1 * | 11/2012 | Cheng .................... A61K 39/21 424/189.1 |

FOREIGN PATENT DOCUMENTS

| CA | WO 2010047839 A1 * | 4/2010 | ........... C07K 14/005 |
| EP | 2 065 462 A1 | 6/2009 | |

OTHER PUBLICATIONS

Hellebrand E, Mautner J, Reisbach G, Nimmerjahn F, Hallek M, Mocikat R, Hammerschmidt W. Epstein-Barr virus vector-mediated gene transfer into human B cells: potential for antitumor vaccination. Gene Ther. Jan. 2006;13(2):150-62.*
Farina A, Feederle R, Raffa S, Gonnella R, Santarelli R, Frati L, Angeloni A, Torrisi MR, Faggioni A, Delecluse HJ. BFRF1 of Epstein-Barr virus is essential for efficient primary viral envelopment and egress. J Virol. Mar. 2005;79(6):3703-12.*
Kieff and B. Rickinson. (2006), Epstein-Barr virus and its replication, In D. M. Knipe and P. M. Howley (ed.), Fields virology, 5th ed. Lippincott-Raven, Philadelphia, PA. 2603-2654.
de Jesus O et al., "Updated Epstein-Barr virus (EBV) DNA sequence and analysis of a promoter for the BART (CST, BARFO) RNAs of EBV," (2003) J. Gen. Virol. 84, 1443-1450.
Dolan A et al., "The Genome of Epstein-Barr Virus Type 2 Strain AG876," (2006) Virology vol. 350, 164-170.
Feederle, R, et al. (2006), Epstein-Barr virus BNRF1 protein allows efficient transfer from the endosomal compartment to the nucleus of primary B lymphocytes. J Virol. 80(19):9435-43.
Hammerschmidt W, Sudgen B (1989) Genetic analysis of immortalizing functions of Epstein-Barr virus in human B-lymphocytes. Nature 340: 393-397.

(Continued)

*Primary Examiner* — Rachel B Gill
(74) *Attorney, Agent, or Firm* — Foley & Lardner LLP

(57) ABSTRACT

The present invention relates to an Epstein-Barr virus-like particle (EB-VLP) substantially free of Epstein-Barr Virus (EBV) DNA. The present invention also relates to a polynucleotide comprising an EBV genome a) lacking at least one expressible gene selected from the group consisting of the BFLF1 gene, the BBRF gene, the BGRF1 gene, the BDRF1 gene, the BALF3 gene, the BFRF1A gene, and the BFRF1 gene, and b) producing the EB-VLP of the invention in a suitable host cell. The present invention further relates to a vector and a host cell comprising the polynucleotide of the invention as well to a method of manufacturing the EB-VLPs, a method of manufacturing a vaccine thereof, a vaccine and a composition comprising the EB-VLPs.

17 Claims, 9 Drawing Sheets

(56) References Cited

OTHER PUBLICATIONS

Figure 1:
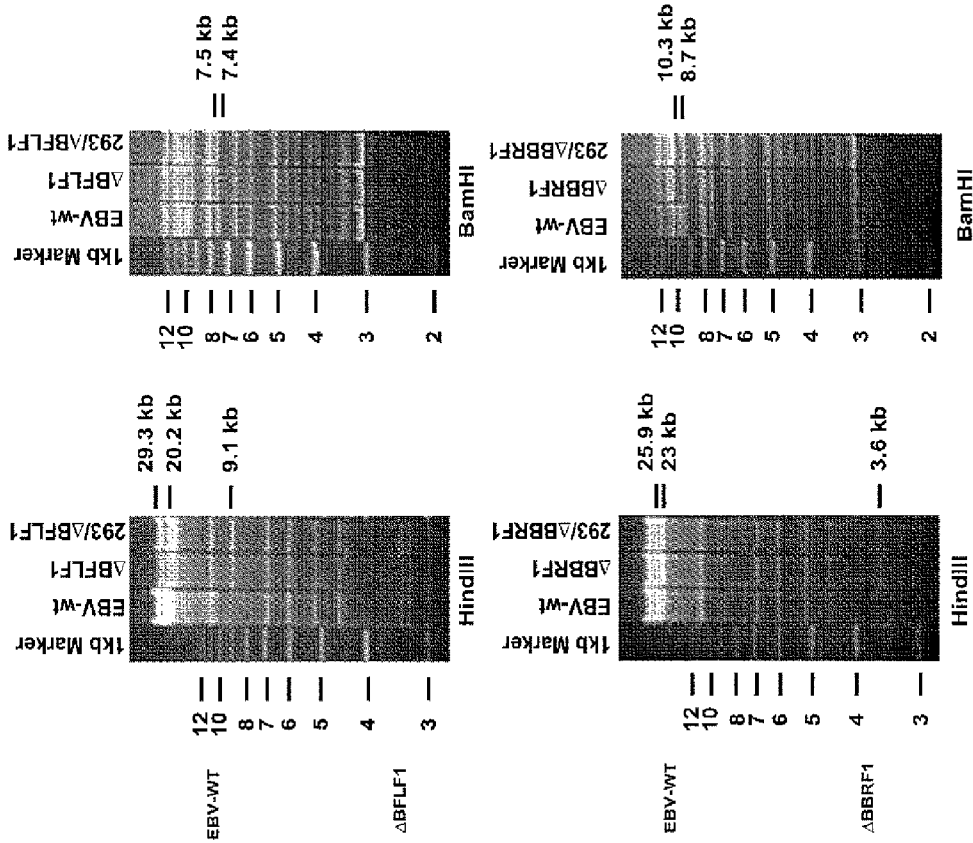
Figure 1:
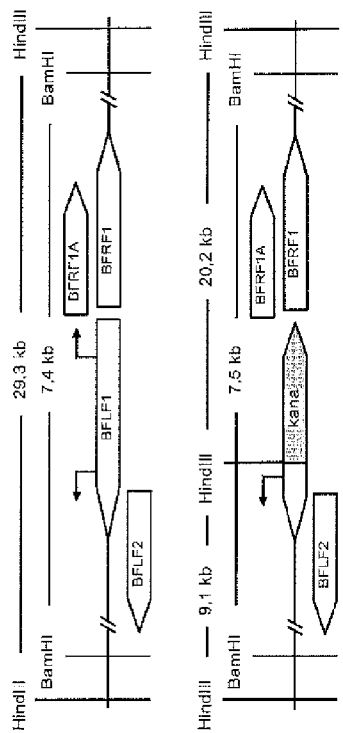
Figure 1:
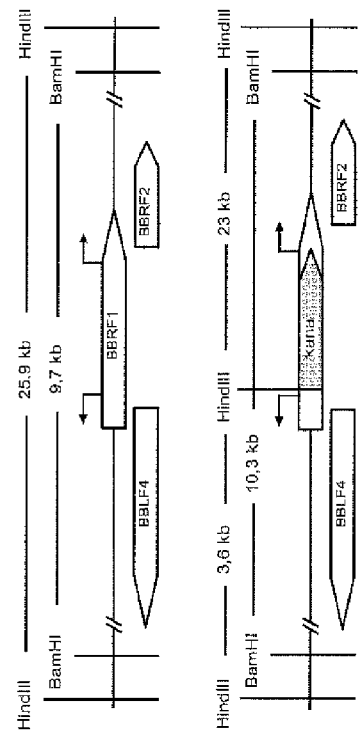

Cohen JI, et al. (1989) Epstein-Barr virus nuclear protein 2 is a key determinant of lymphocyte transformation. PNAS 86:9558-9562.
Kaye KM, et al. (1993) Epstein-Barr virus latent membrane protein 1 is essential for B-lymphocyte growth transformation. PNAS, 90, 9150-9154.
Tomkinson B, et al. (1993) Epstein-Barr virus nuclear proteins EBNA3A and EBNA3C are essential for B-lymphocyte growth transformation. J. Virol. 62:6762-6771.
Delecluse et al., "Propagation and recovery of intact, infectious Epstein-Barr virus from prokaryotic to human cells," Proc Natl Acad Sci U S A. Jul. 7, 1998;95(14):8245-50.
Delecluse, et al., "A first-generation packaging cell line for Epstein-Barr virus-derived vectors," Natl Acad Sci U S A. Apr. 27, 1999;96(9):5188-93.
Küppers, R. (2003). B cells under influence: transformation of B cells by Epstein-Barr virus, Nat. Rev. Immunol. 3:801-812.
Laichalk, L. L., and D. A. Thorley-Lawson. (2005), Terminal differentiation into plasma cells initiates the replicative cycle of Epstein-Barr virus in vivo. J. Virol. 79:1296-1307.
Rickinson, A. B., and E. Kieff. (2006), Epstein-Barr virus, In D. M. Knipe and P. M. Howley (ed.), Fields virology, 5th ed. Lippincott-Raven, Philadelphia, PA., 2655-2700.
Rooney, C. M., et al., (1998), Infusion of cytotoxic T cells for the prevention and treatment of Epstein-Barr virus-induced lymphoma in allogeneic transplant recipients. Blood 92:1549-1555.
Rees L, et al. (2009), A phase I trial of Epstein-Barr virus gp350 vaccine for children with chronic kidney disease awaiting transplantation. Transplantation 88(8):1025-9.
Greenstone, H. L., et. al. (1998), Chimeric papillomavirus virus-like particles elicit antitumor immunity against the E7 oncoprotein in an HPV16 tumor model. Proc. Natl. Acad. Sci. USA 95:1800-1805.
Mandic, A., and T. Vujkov. (2004). Human papillomavirus vaccine as a new way of preventing cervical cancer: a dream or the future? Ann. Oncol. 15:197-200.
Roizman, B., and D. M. Knipe. (2001), Herpes simplex viruses and their replication, In D. M. Knipe, P. M. Howley, D. E. Griffin, R. A. Lamb, M. A. Martin, B. Roizman, and S. E. Straus (ed.), Fields virology, 4th ed., vol. 2. Lippincott Williams & Wilkins, Philadelphia, Pa., 2399-2459.
Feederle R, et al., (2005), Defective infectious particles and rare packaged genomes produced by cells carrying terminal-repeat-negative Epstein-Barr virus. J. Virol. 79; 7641-7.
Ruiss Romana et al: "A virus-like particle-based Epstein-Barr virus vaccine.", Journal of Virology Dec. 2011, vol. 85, No. 24, Oct. 12, 2011, pp. 13105-13113.
Granato Marisa et al: "Deletion of Epstein-Barr virus BFLF2 leads to impaired viral DNA packaging and primary egress as well as to the production of defective viral particles", Journal of Virology, The American Society for Microbiology, US, vol. 82, No. 8, Apr. 1, 2008, pp. 4042-4051.
Feederle et al., "Epstein-Barr Virus Genetics: Talking about the BAC Generation," *Herpesviridae* Biomed Central LTD, vol. 1, No. 6, (2010), 13 pages.
Hettich E et al: "Genetic design of an optimized packaging cell line for gene vectors transducing human B cells", Gene Therapy, Macmillan Press Ltd., Basingstoke, GB, vol. 13, No. 10, May 1, 2006, pp. 844-856.
Farina Antonella et al: "BFRF1 of Epstein-Barr virus is essential for efficient primary viral envelopment and egress.", Journal of Virology Mar. 2005, vol. 79, No. 6, pp. 3703-3712.
Pavlova Sophia et al: "An Epstein-barr virus mutant produces immunogenic defective particles devoid of viral DNA.", Journal of Virology Feb. 2013, vol. 87, No. 4, Dec. 12, 2012, pp. 2011-2022.
International Search Report issued in related International Patent Application No. PCT/EP2012/077007, mailed Feb. 28, 2013.
International Preliminary Report on Patentability issued in related International Patent Application No. PCT/EP2012/077007, issued Jul. 1, 2014.
Gonnella et al., "Characterization and Intracellular Localization of the Epstein-Barr Virus Protein BFLF2: Interactions with BFRF1 and with the Nuclear Lamina," *Journal of Virology*, pp. 3713-3727 (2005).
Yu et al., "Genetic Analysis of the UL 15 Gene Locus for the Putative Terminase of Herpes Simplex Virus Type 1," *Virology*, vol. 243, pp. 32-44 (1998).
Beard et al., "DNA Cleavage and Packaging Proteins Encoded by Genes UI28, UI15, and UL33 of Herpes Simplex Virus Type 1 Form a Complex in Infected Cells," *Journal. of Virology*, pp. 4785-4791 (2002).

\* cited by examiner

WT

ΔBFLF1

RPMI

ΔTR

SECOND GENERATION VIRUS-LIKE PARTICLES (VLP) FROM EPSTEIN-BARR VIRUSES FOR VACCINATION PURPOSES

The present invention relates to an Epstein-Barr virus-like particle (EB-VLP) substantially free of Epstein-Barr Virus (EBV) DNA. The present invention also relates to a polynucleotide comprising an EBV genome a) lacking at least one expressible gene selected from the group consisting of the BFLF1 gene, the BBRF1 gene, the BGRF1 gene, the BDRF1 gene, the BALF3 gene, the BFRF1A gene, and the BFRF1 gene, and b) producing the EB-VLP of the invention in a suitable host cell. The present invention further relates to a vector and a host cell comprising the polynucleotide of the invention as well as to a method of manufacturing said EB-VLPs, a method of manufacturing a vaccine thereof, a vaccine and a composition comprising said EB-VLPs.

The oncogenic Epstein-Barr virus (EBV) belongs to the family of gammaherpesviruses that can infect human B lymphocytes latently. The EBV establishes lifelong persistent B-cell infections in more than 90% of the human population (Kieff and B. Rickinson. (2006), Epstein-Barr virus and its replication, In D. M. Knipe and P. M. Howley (ed.), Fields virology, 5th ed. Lippincott-Raven, Philadelphia, Pa. 2603-2654; Küppers, R. (2003). B cells under influence: transformation of B cells by Epstein-Barr virus, Nat. Rev. Immunol. 3:801-812). In healthy individuals, the majority of EBV infected B cells show limited viral gene expression and a resting phenotype. The terminal differentiation of latently infected cells into plasma cells leads to virus reactivation, production, and reinfection of B cells (Laichalk, L. L., and D. A. Thorley-Lawson. (2005), Terminal differentiation into plasma cells initiates the replicative cycle of Epstein-Barr virus in vivo. J. Virol. 79:1296-1307). The expression of all viral latency genes causes growth transformation and the proliferation of infected B cells, which is reflected by the outgrowth of EBV-transformed lymphoblastoid B-cell lines in vitro and by the association of EBV with a variety of B-cell lymphoproliferative diseases, including different types of lymphoma, in vivo. EBV infection is controlled by T cells, as indicated by an increased incidence of EBV-associated malignancies in patients with congenital or iatrogenically induced T-cell dysfunction (Rickinson, A. B., and E. Kieff. (2006), Epstein-Barr virus, In D. M. Knipe and P. M. Howley (ed.), Fields virology, 5th ed. Lippincott-Raven, Philadelphia, Pa., 2655-2700.) and by the successful treatment of EBV-associated posttransplant lymphoproliferative disease in hematopoietic stem cell transplant recipients by the infusion of polyclonal EBV-specific T-cell lines (Rooney, C. M., et al., (1998), Infusion of cytotoxic T cells for the prevention and treatment of Epstein-Barr virus-induced lymphoma in allogeneic transplant recipients. Blood 92:1549-1555).

There is thus a need in the art to develop a vaccine to prevent or clear EBV infection. Such a vaccine would be applied to an apparently healthy subject, so safety of such a vaccine would be a major concern. So far, there is only a peptidic vaccine against EBV gp350 commercially available. However, first clinical trials with this vaccine show it does not prevent EBV infection in EBV-negative transplant recipients (Rees L, et al. (2009), A phase I trial of Epstein-Barr virus gp350 vaccine for children with chronic kidney disease awaiting transplantation. Transplantation 88(8): 1025-9.).

Virus-like particles (VLPs) are structures similar or identical to mature virions but lack the viral genome. In general, they stimulate the host's immune response to a higher extent than e.g. monomeric peptides do, which is why they have been preferentially used for vaccination against several viruses such as hepatitis B and papillomavirus (Greenstone, H. L., et. al. (1998), Chimeric papillomavirus virus-like particles elicit antitumor immunity against the E7 oncoprotein in an HPV16 tumor model. Proc. Natl. Acad. Sci. USA 95:1800-1805; Mandic, A., and T. Vujkov. (2004). Human papillomavirus vaccine as a new way of preventing cervical cancer: a dream or the future? Ann. Oncol. 15:197-200). A crucial safety aspect of VLP vaccine regimes is that the VLPs used have to be free of viral genomes (DNA or RNA), since otherwise vaccination could induce virus replication and/or latent infection by the virus.

The viral lytic replication, i.e. the processes leading to the formation of progeny viral particles, of EBV and other herpesviruses is a complex process that results from sequential activation of different protein classes. During lytic replication, the viral genome is amplified several thousand times from the different origins of replication to form highly branched structures. These large concatemers are then resolved into unit-length linear viral genomes that will be packaged into preformed procapsids within the infected cell nucleus. Capsids containing viral DNA will undergo further conformational and structural changes and egress from the infected cell as enveloped virion particles (Roizman, B., and D. M. Knipe. (2001), Herpes simplex viruses and their replication, In D. M. Knipe, P. M. Howley, D. E. Griffin, R. A. Lamb, M. A. Martin, B. Roizman, and S. E. Straus (ed.), Fields virology, 4th ed., vol. 2. Lippincott Williams & Wilkins, Philadelphia, Pa., 2399-2459.). One essential cis element that leads to EBV encapsidation are the terminal repeats (TRs) located at both ends of the linear genome that are involved in the excision of individual viral genomes from the concatemers formed during viral lytic replication as well as in their packaging. An EBV mutant strain in which these terminal repeats had been deleted (delTR-EBV) has been generated. It has been shown that after induction of the lytic cycle a large amount of empty EB-VLPs is produced and that the efficiency of genome encapsidation is markedly low, since as few as 0.001% of cells infected with supernatants containing delTR-EBV express a marker gene from said genome, as compared to 29% when a control EBV is used (Feederle R, et al., (2005), Defective infectious particles and rare packaged genomes produced by cells carrying terminal-repeat-negative Epstein-Barr virus. J. Virol. 79; 7641-7) This indicates that the terminal repeats are important but not absolutely essential for genome encapsidation. Moreover, it has been shown that VLPs produced from delTR-EBV still—though rarely—infect cells, thus not warranting safety of the delTR-EBV VLPs for use as a vaccine.

In summary, notwithstanding the existing need, so far no method for producing a safe and efficient vaccine against EBV has been developed. Thus, the technical problem underlying the invention can be seen as the provision of means and methods which allow for the efficient production of an EBV vaccine. The technical problem is solved by the embodiments characterized in the claims and herein below.

Therefore the present invention relates to an Epstein-Barr virus-like particle (EB-VLP) substantially free of Epstein-Barr Virus (EBV) DNA.

The term "Epstein-Barr virus like particle" or "EB-VLP" as used herein refers to a viral particle derived from an EBV neither replicating lytically nor establishing latent infection in a suitable host cell. EB-VLPs, preferably, have an essentially typical herpesviral structure as analysed by electron microscopy, i.e. they have a capsid, a tegument, and an outer membrane. However, in contrast to the normal herpesviral particle, the EB-VLPs of the present invention are empty, i.e. they do not contain EBV DNA, preferably no DNA at all. The EB-VLPs comprise the EB-viral proteins (e.g., capsid, tegument, coat, shell, surface or envelope proteins and glycoproteins) known to the skilled artisan for the known EBV types (e.g. EBV type 1: Genbank Acc No: NC_007605.1 GI:82503188; genome: SEQ ID NO: 1; de Jesus O et al. (2003) J. Gen. Virol. 84, 1443-1450 and EBV type 2: Genbank Acc No: NC_009334.1 GI:139424470; Dolan A et al. (2006) Virology Vol. 350, 164-170), genome: SEQ ID NO: 2, including strain M81 (SEQ ID NO: 38)).

In addition to EBV-encoded proteins, the EB-VLP may also comprise one or more artificial polypeptides. The term "artificial polypeptide" relates to any polypeptide incorporated into an EB-VLP which is not comprised in a wildtype EBV. If an artificial polypeptide is incorporated into, and therefore comprised in, an EB-VLP, can be assessed by obtaining EB-VLPs according to the methods of the present invention, separating EB-VLPs from the producing cells, e.g. by centrifugation or by immunoprecipitation as described in the examples below, followed by determining the presence of the artificial polypeptide in said EB-VLPs, which can be accomplished e.g. by the immunoblot method described in the examples or by any other method suited for the specific polypeptide and known to the artisan.

Preferably, the artificial polypeptide is a fusion polypeptide comprising a membrane-integral part of a herpesviral glycoprotein. More preferably, the artificial polypeptide is a fusion polypeptide comprising the transmembrane domain of the herpes simplex virus gC protein.

In a preferred embodiment the artificial polypeptide further comprises a detectable tag. The term "detectable tag" refers to a stretch of amino acids which are added to or introduced into the fusion polypeptide of the invention. Preferably, the tag shall be added C- or N-terminally to the fusion polypeptide of the present invention. The said stretch of amino acids shall allow for detection of the fusion polypeptide by an antibody which specifically recognizes the tag or it shall allow for forming a functional conformation, such as a chelator or it shall allow for visualization by fluorescent tags. Preferred tags are the Myc-tag, FLAG-tag, 6-His-tag, HA-tag, GST-tag or GFP-tag. These tags are all well known in the art. In a further preferred embodiment, said fusion protein comprises a peptide or polypeptide comprising the amino acid sequence of an immunogenic protein, preferably an immunogenic protein of a pathogenic microorganism, more preferably an EBV protein, most preferably a latent EBV protein.

It is, however, also envisaged by the present invention that one or more non-essential EB-viral polypeptides is or are lacking from the EB-VLP. In the context of the present specification, "non-essential EBV polypeptide" relates to a polypeptide incorporated into wildtype EB-viral particles but not essential for the formation of VLPs. A polypeptide is non-essential if VLPs are detectable by electron microcopy or one of the other methods described in the examples of the present specification after suitable host cells have been induced to produced to produce VLPs according to the methods of the present specification in the absence of said polypeptide. E.g., the product of the EBV BNRF1 gene, which was shown to play a role in the escape of EBV particles from endosomes after infection (Feederle, R, et al. (2006), Epstein-Barr virus BNRF1 protein allows efficient transfer from the endosomal compartment to the nucleus of primary B lymphocytes. J Virol. 80(19):9435-43) may be lacking from an EB-VLP. The methods how to omit a polypeptide from a host cell during lytic infection of EBV are well-known to the skilled artisan. Preferably, a polypeptide is omitted by deleting the gene coding for said polypeptide from the viral genome or by rendering said gene unexpressible by means of genetic manipulation, e.g. by mutating the start codon to a non-start codon.

The term "substantially free of EBV DNA" as used herein will be understood by those skilled in the art. That said term does not necessarily mean that all EB-VLPs are free of EBV DNA. The term, however, requires that the number of EBV DNA free EB-VLPs produced by the method of the invention is increased by a statistically significant portion compared to control EB-VLPs. Control VLPs are delTR-EBV VLPs as described herein above. Whether a portion is statistically significant can be determined without further ado by the person skilled in the art using various well known statistic evaluation tools, e.g., determination of confidence intervals, p-value determination, Student's t-test, Mann-Whitney test, etc. Details are found in Dowdy and Wearden, Statistics for Research, John Wiley & Sons, New York 1983. The p-values are, preferably, 0.1, 0.05, 0.01, 0.005, or 0.0001. Further, the number of EBV DNA containing EB-VLPs produced by the method of the present invention is preferably decreased by at least fivefold, at least tenfold, at least 20 fold, at least 50 fold, at least 100 fold, at least 1000 fold, or at least 10000 fold compared to control EB-VLPs.

Preferably, EB-VLPs substantially free of EBV DNA are EB-VLPs containing less than 10000 EBV genomes/ml supernatant, more preferably less than 1000 EBV genomes/ml supernatant, even more preferably less than 100 EBV genomes/ml supernatant, and most preferably less than 10 EBV genomes/ml supernatant (when produced and assayed in the PCR assay as described in the examples of the current specification. Preferably, the number of EBV genomes is less than $200/10^6$ EBV-VLPs, less than $100/10^6$ EBV-VLPs, less than $50/10^6$ EBV-VLPs, less than $20/10^6$ EBV-VLPs, less than $10/10^6$ EBV-VLPs, less than $1/10^6$ EBV-VLPs, less than $0.1/10^6$ EBV-VLPs, or less than $0.01/10^6$ EBV-VLPs.

Preferably, EB-VLPs substantially free of EBV DNA are EB-VLPs establishing latent infection in Raji cells at a rate of less than 10 infected cells/ml supernatant, more preferably less than 1 infected cell/ml supernatant, even more preferably less than 0.1 infected cells/ml supernatant, most preferably less than 0.01 infected cells/ml supernatant when produced and assayed in the infection assay as described in the examples of the current specification. Preferably, the rate is less than 10 infected Raji cells/$10^6$ EB-VLPs, more preferably less than 1 infected cell/$10^6$ EB-VLPs, even more preferably less than 0.1 infected cells/$10^6$ EB-VLPs, most preferably less than 0.01 infected cells/$10^6$ EB-VLPs.

Preferably, the EB-VLPs of the present invention are used as a medicament. The term "use as a medicament" as used herein relates to the use of EB-VLP as an agent in the diagnosis, cure, treatment, or prevention of disease.

Also preferably, the EB-VLPs of the present invention are used for vaccination. "Vaccination", as used herein, relates to the administration of antigenic material to stimulate the immune system of a subject to develop adaptive immunity. Vaccination is therapeutic or prophylactic vaccination.

Therapeutic vaccination refers to vaccination in order to ameliorate or cure a disease or a disorder referred to herein or the symptoms accompanied therewith to a significant extent. Therapeutic vaccination may lead to an entire restoration of the health with respect to the diseases or disorders referred to herein. It is to be understood that therapeutic vaccination as used in accordance with the present invention may not be effective in all subjects. However, the term shall require that a statistically significant portion of subjects suffering from a disease or disorder referred to herein can be successfully treated. Whether a portion is statistically significant can be determined without further ado by the person skilled in the art using various well known statistic evaluation tools, e.g., determination of confidence intervals, p-value determination, Student's t-test, Mann-Whitney test etc. Preferred confidence intervals are at least 90%, at least 95%, at least 97%, at least 98% or at least 99%. The p-values are, preferably, 0.1, 0.05, 0.01, 0.005, or 0.0001. Preferably, the treatment shall be effective for at least 60%, at least 70%, at least 80%, or at least 90% of the subjects of a given cohort or population.

Prophylactic vaccination relates to vaccination in order to retaining health with respect to the diseases or disorders referred to herein for a certain period of time, preferably life-long, in a subject. It will be understood that the said period of time is dependent on the amount of the EB-VLPs which has been administered and individual factors of the subject discussed elsewhere in this specification. It is to be understood that prophylactic vaccination may not be effective in all subjects treated with the EB-VLP according to the present invention. However, the term requires that a statistically significant portion of subjects of a cohort or population are effectively prevented from suffering from a disease or disorder referred to herein or its accompanying symptoms. Preferably, a cohort or population of subjects is envisaged in this context which normally, i.e. without prophylactic vaccination according to the present invention, would develop a disease or disorder as referred to herein. Whether a portion is statistically significant can be determined without further ado by the person skilled in the art using various well known statistic evaluation tools discussed elsewhere in this specification.

The definitions made above apply mutatis mutandis to the following:

In a further embodiment, the present invention relates to a polynucleotide comprising an EBV genome a) lacking at least one expressible gene selected from the group consisting of the BFLF1 gene, the BBRF1 gene, the BGRF1 gene, the BDRF1 gene, the BALF3 gene, the BFRF1A gene, and the BFRF1 gene, and b) being capable of producing the EB-VLP of present invention in a suitable host cell.

The term "polynucleotide" as used herein refers to a linear or circular nucleic acid molecule. The polynucleotide of the present invention shall be provided, preferably, either as an isolated polynucleotide (i.e. isolated from its natural context) or in genetically modified form. The term encompasses single as well as double stranded polynucleotides. Moreover, comprised are also chemically modified polynucleotides including naturally occurring modified polynucleotides such as glycosylated or methylated polynucleotides or artificially modified derivatives such as biotinylated polynucleotides.

The polynucleotide of the present invention comprises an EBV genome lacking at least one expressible gene selected from the group consisting of the BFLF1 gene (gene for EBV type 1: SEQ ID NO: 3; protein product SEQ ID NO: 4, Genbank Acc. No: YP_401648.1 GI:82503206; gene for EBV type 2: SEQ ID NO: 5; protein product SEQ ID NO: 6, Genbank Acc. No: YP_001129444.1 GI:139424479), the BBRF1 gene (gene for EBV type 1: SEQ ID NO: 7; protein product SEQ ID NO: 8, Genbank Acc. No: YP_401682.1 GI:82503238; gene for EBV type 2: SEQ ID NO: 9; protein product SEQ ID NO: 10, Genbank Acc. No: YP_001129476.1 GI:123811640), the BGRF1/BDRF1 gene (gene for EBV type 1: SEQ ID NO: 11, protein product SEQ ID NO: 12, Genbank Acc. No: YP_401690.1 GI:82503246; gene for EBV type 2: SEQ ID NO: 13; protein product SEQ ID NO: 14, Genbank Acc. No: YP_001129485.1 GI:139424519), the BALF3 gene (gene for EBV type 1: SEQ ID NO: 15; protein product SEQ ID NO: 16, Genbank Acc. No: YP_401715.1 GI:82503271; gene for EBV type 2: SEQ ID NO: 17; protein product SEQ ID NO: 18, Genbank Acc. No: YP_001129509.1 GI:139424543), the BFRF1A gene (gene for EBV type 1: SEQ ID NO: 19; protein product SEQ ID NO: 20, Genbank Acc. No: YP_401728.1 GI:82503279; gene for EBV type 2: SEQ ID NO: 21; protein product SEQ ID NO: 22, Genbank Acc. No: YP_001129445.1 GI:139424480), and the BFRF1 gene (gene for EBV type 1: SEQ ID NO: 23; protein product SEQ ID NO: 24, Genbank Acc. No: YP_401649.1 GI:82503207; gene for EBV type 2: SEQ ID NO: 25; protein product SEQ ID NO: 26, Genbank Acc. No: YP_001129446 GI:139424481). The products of said genes are proteins with an activity essential for the packaging of viral DNA into procapsids of EBV, thus removal of their function leads to production of the EB-VLP of the present invention. The term "lacking an expressible gene" relates to an EBV genome in which at least one gene selected from the group as defined supra has been modified such that a functional protein product can not be expressed. This can be accomplished in various ways known to the skilled person and detailed in the examples below.

Preferably, at least one of the genes supra is modified by introducing a deletion, addition and/or substitution of at least one nucleotide leading to a truncation, disruption or mutation of the protein produced from the said gene. Such modifications encompass point mutations in gene resulting in the generation of a stop codon as well as modifications resulting in a shift of the open reading frame. Such polypeptides being created are abnormally short or abnormally long and have no biological function. Also encompassed are point mutations in gene which result in a polypeptide with no or with a decreased biological function. Also preferably, a deletion, addition and/or substitution of at least one nucleotide can be, preferably, introduced which leads to an inactivation of the transcriptional control sequence (i.e. the promoter) which governs expression of the gene. Moreover, sequences may be, preferably, introduced which in the transcribed RNA result in increased RNA degradation. More preferably, the entire locus for the at least one the of genes supra is deleted or replaced by a non-functional or non-expressible nucleic acid. Most preferably, the open reading frame is substituted by a selectable marker gene, such as the kanamycin resistance gene as indicated in the Figures and Examples, below.

The test if a given modification of one of the genes supra leads to a non-expressible gene will depend on the nature of the modification introduced as will be known to the skilled artisan. E.g. if a large part of the coding sequence of a gene has been deleted, electrophoretic separation of EBV proteins followed by immunoblotting with an antibody specific for the protein product of said gene will be appropriate, since the product of the gene containing the deletion will have a lower apparent molecular mass. On the other hand, if one of the genes supra is deleted entirely, restriction analysis of the resulting EBV genome may be sufficient. In each case, loss of the function of one of the genes supra can be assayed by detecting EB-VLP of the present invention, i.e. EB-VLP substantially free of EBV DNA according to the methods detailed herein below.

The polynucleotide of the present invention is a polynucleotide comprising an EBV genome with the biological activity of directing production of EB-VLP according to the present invention in a suitable host cell. Suitable assays for measuring said activity are described in the accompanying examples. Preferably, the polynucleotide comprises one of the nucleic acid sequences shown in SEQ ID NO: 27 (an EBV type 1 genome comprising a BFLF1 knockout, i.e. lacking an expressible BFLF1 gene) or in SEQ ID NO: 28 (an EBV type 1 genome comprising a BBRF1 knockout, i.e. lacking an expressible BBRF1 gene).

Moreover, the term "polynucleotide" as used in accordance with the present invention further encompasses variants of the aforementioned specific polynucleotides. Said variants may represent strain or clonal variants of the polynucleotide of the present invention. The polynucleotide variants, preferably, comprise a nucleic acid sequence characterized in that the sequence can be derived from the aforementioned specific nucleic acid sequences by at least one nucleotide substitution, addition and/or deletion whereby the variant nucleic acid sequence shall still encode an EBV genome having the activity as specified above. A polynucleotide comprising a fragment of any of the aforementioned nucleic acid sequences is also encompassed as a polynucleotide of the present invention. The fragment shall encode an EBV genome which still has the activity as specified above.

The polynucleotides of the present invention either essentially consist of the aforementioned nucleic acid sequences or comprise the aforementioned nucleic acid sequences. Thus, they may contain further nucleic acid sequences as well. Specifically, the polynucleotides of the present invention may encode fusion proteins wherein one partner of the fusion protein is a polypeptide being encoded by a nucleic acid sequence recited above. Such fusion proteins may comprise as additional part polypeptides for monitoring expression (e.g., green, yellow, blue or red fluorescent proteins, alkaline phosphatase and the like) or so called "tags" which may serve as a detectable marker or as an auxiliary measure for purification purposes. Tags for the different purposes are well known in the art and comprise FLAG-tags, 6-histidine-tags, MYC-tags and the like.

Preferably, the polynucleotide of the present invention comprises alterations in addition to the modifications detailed above. Especially, since some of the latent gene products of EBV are known or suspected to have a transforming effect on cells (EBNA2, LMP1, EBNA3A, -B and -C (Hammerschmidt W, Sudgen B (1989) Genetic analysis of immortalizing functions of Epstein-Barr virus in human B-lymphocytes. Nature 340: 393-397; Cohen J I, et al. (1989) Epstein-Barr virus nuclear protein 2 is a key determinant of lymphocyte transformation. PNAS 86:9558-9562; Kaye K M, et al. (1993) Epstein-Barr virus latent membrane protein 1 is essential for B-lymphocyte growth transformation. PNAS, 90, 9150-9154; Tomkinson B, et al. (1993) Epstein-Barr virus nuclear proteins EBNA3A and EBNA3C are essential for B-lymphocyte growth transformation. J. Virol. 62:6762-6771)), it is desirable to remove the genes coding for these transforming proteins from the polynucleotide of the present invention. Also, the BZLF1 gene product is known to be the major activation protein that mediates entry of EBV into its lytic cycle, i.e. the virus-producing part of its life-cycle. It is thus preferable to remove this functionality from the polynucleotide of the present invention in order to avoid virus production from residual genomes applied to a subject, e.g. during vaccination. The methods of functionally deleting said genes are the same as detailed supra. More preferably, at least one, most preferably all of said genes are deleted entirely.

The term "suitable host cell" as used herein relates to a cell capable of facilitating lytic replication of EBV, leading to the production of EB-VLPs. Preferably, said cell is a mammalian cell, more preferably a primate cell, even more preferably a human cell. Most preferably, the host cell is a 293 cell. It is also envisaged by the current invention that the host cell may provide certain factors essential for lytic replication of EBV. E.g. where an EBV genome lacking a functional BZLF1 gene is used, which causes the virus to be unable to enter the lytic cycle, such function may be provided by the host cell after an expression construct for said BZLF1 gene has been transfected into the cell.

The methods for generating said modifications are well known to the person skilled in the art and include gene targeting methods based on homologous recombination, PCR-based mutagenesis, chemical mutagenesis using agents such as ENU or EMS, mutagenesis by irradiation and others. In particular, the entire gene locus can be deleted by homologous recombination as described in the accompanying Examples below.

In another preferred embodiment, the present invention relates to a vector comprising the polynucleotide of the present invention. Preferably, the vector is a plasmid or viral vector capable of stably maintaining an EBV genome in a cell. More preferably, the vector is derived from the *Escherichia coli* (*E. coli*) F-Plasmid; these vectors are known to the skilled person as F-factor based replicon or bacterial artificial chromosome (BAC), which allow for stably maintaining a complete EBV genome in *E. coli* bacterial cells. Moreover, the term also relates to targeting constructs which allow for random or site-directed integration of the targeting construct into genomic DNA. Such target constructs, preferably, comprise DNA of sufficient length for either homologous recombination or heterologous insertion.

The vector encompassing the polynucleotides of the present invention, preferably, further comprises selectable markers for propagation and/or selection in a host. The vector may be incorporated into a host cell by various techniques well known in the art. If introduced into a host cell, the vector may reside in the cytoplasm or may be incorporated into the genome. In the latter case, it is to be understood that the vector may further comprise nucleic acid sequences which allow for homologous recombination or heterologous insertion. Vectors can be introduced into prokaryotic or eukaryotic cells via conventional transformation or transfection techniques. Vectors and transformation or transfection techniques are well known in the art and can be applied by the person skilled in the art without further ado. For example, a BAC plasmid vector can be introduced into *E. coli* cells by electroporation, or into mammalian cells in a complex with charged lipids.

In another preferred embodiment, the present invention relates to a host cell comprising the polynucleotide or the vector of the present invention.

Host cells as referred to herein encompass eukaryotic cells as well as prokaryotic cells. In particular, prokaryotic cells referred to in accordance with the present invention may be bacterial cells that can be used for the propagation of, e.g., the polynucleotide or vector of the present invention. Preferred bacteria for this purpose are *E. coli* bacteria, more preferably strain DH10B. Eukaryotic cells are, preferably, cells which are capable of expressing genes of the EBV genome comprised in the polynucleotide or vector of the invention. Preferred cells expressing genes of the latent cycle of the EBV life cycle are, e.g., Raji cells. More preferably, said cells are capable of assembling Epstein-Barr virus like particles (EBV-VLP), i.e. suitable host cells as described above.

In another preferred embodiment, the present invention relates to a method for manufacturing EB-VLPs substantially free of EBV DNA, comprising the steps of a) culturing a suitable host cell comprising the polynucleotide or the vector of the present invention, and b) obtaining EB-VLPs substantially free of EBV DNA from the cells.

The method of the present invention, preferably, is an in vitro method. Moreover, it may comprise steps in addition to those explicitly mentioned above. For example, further steps may relate to pre-treatments of suitable host cells or post-treatments of harvested supernatants comprising EB-VLPs.

The term "culturing" is known by the person skilled in the art. Particularly, the term relates to cells growing outside the organism in a cell culture medium. The term also relates to the process of growing cells in culture outside the organism. Suitable cell culture media are known by the person skilled in the art and are commercially available. They may comprise nutrients, salts, growth factors, antibiotics, serum (e.g. fetal calf serum) and pH-indicators (e.g. phenol red). Preferably, the method further comprises the step of expressing at least one gene coding for an artificial polypeptide as described herein above in the suitable host cell, leading to the incorporation of said artificial polypeptide into the EB-VLPs.

The term "obtaining" refers to an isolation and/or purification step known to the person skilled in the art. Preferably, after said isolation and/or purification the EB-VLPs exhibit a purity of at least 80%, preferably 80%-90%, more preferably 90%-97%, most preferred more than 97% up to an absolute pure form without any contamination. The term "purification" encompasses means and methods such as chromatographic devices. Preferably used methods may include density gradient centrifugation, size-exclusion chromatography, affinity chromatography, and precipitation and columns. Preferably, obtaining EB-VLPs includes purification of EB-VLPs by binding them to magnetic beads via anti-gp350 antibodies as described in the examples herein below. Preferably, EB-VLP are obtained from the supernatant of suitable host cells, i.e. the EB-VLPs are released into the medium during the method of the present invention.

In a preferred embodiment, the present invention relates to a method for the manufacture of a vaccine comprising the steps of the method of the present invention and the further step of formulating the EB-VLPs as a vaccine. In another preferred embodiment, the present invention relates to a vaccine containing EB-VLPs substantially free of EBV DNA obtainable by the method according the present invention.

The term "vaccine" as used herein, preferably, relates to a composition comprising EB-VLPs substantially free of DNA according to the present invention which—when administered to an animal, preferably a human-elicits an immune response against EBV. Thus, administering said vaccine stimulates the immune system and establishes or improves immunity to infection with EBV. Preferably, the vaccine according to the present invention allows for establishing or improving immunity to infection with EBV. Preferably, the immunization causes activation and expansion of T-cells and/or B-cells specifically recognizing structural EBV antigens. More preferably, immunization causes the production of antibodies preventing infection of body cells by EBV.

The vaccine of the invention, preferably, further comprises one or more pharmaceutically acceptable carrier as described in detail below. The vaccine of the present invention can be formulated as pharmaceutically acceptable salt. The vaccines are, preferably, administered topically or systemically. Suitable routes of administration conventionally used for drug administration are oral, intravenous, or parenteral administration as well as inhalation. However, depending on the nature and mode of action of a compound, the vaccines may be administered by other routes as well. Moreover, the compounds can be administered in combination with other vaccines either in a common vaccine or as separated vaccines wherein said separated vaccines may be provided in form of a kit of parts.

The compounds are, preferably, administered in conventional dosage forms prepared by combining the EB-VLPs with standard pharmaceutical carriers according to conventional procedures. These procedures may involve mixing, granulating and compressing or dissolving the ingredients as appropriate to the desired preparation. It will be appreciated that the form and character of the pharmaceutically acceptable carrier or diluent is dictated by the amount of active ingredient with which it is to be combined, the route of administration and other well-known variables.

A therapeutically effective dose refers to an amount of the compounds to be used in a vaccine of the present invention which induces immunization according to the present specification. The dosage regimen will be determined by the attending physician and other clinical factors, preferably in accordance with any one of the above described methods. As is well known in the medical arts, dosages for any one patient may depend upon several factors, including the patient's age, the particular compound to be administered, sex, time and route of administration, general health, and other drugs being administered concurrently. Immunization can be monitored by periodic assessment. A typical dose can be, for example, in the range of 1 to 1000 μg; however, doses below or above this exemplary range are envisioned, especially considering the aforementioned factors.

The vaccines and formulations referred to herein are administered at least once in order to treat or ameliorate or prevent a disease or condition recited in this specification. However, the said vaccines may be administered more than one time, for example up to four times.

Specific vaccines are prepared in a manner well known in the pharmaceutical art and comprise at least EB-VLPs in admixture or otherwise associated with a pharmaceutically acceptable carrier or diluent. For making those specific vaccines, the EB-VLPs will usually be mixed with a carrier or the diluent, or enclosed or encapsulated in a capsule, sachet, cachet, paper or other suitable containers or vehicles. The resulting formulations are to be adopted to the mode of administration, i.e. in the forms of tablets, capsules, suppositories, solutions, suspensions or the like. Dosage recommendations shall be indicated in the prescribers or users instructions in order to anticipate dose adjustments depending on the considered recipient.

In a further preferred embodiment said composition further comprises at least one pharmaceutically acceptable carrier and/or at least one excipient. It is to be understood that the carrier(s) must be acceptable in the sense of being compatible with the other ingredients of the formulation and being not deleterious to the recipient thereof. The pharmaceutical carrier employed may be, for example, either a solid, a gel or a liquid. Exemplary of solid carriers are lactose, terra alba, sucrose, talc, gelatin, agar, pectin, acacia, magnesium stearate, stearic acid and the like. Exemplary of liquid carriers are phosphate buffered saline solution, syrup, oil such as peanut oil and olive oil, water, emulsions, various types of wetting agents, sterile solutions and the like.

The diluent(s) is/are selected so as not to affect the biological activity of the combination. Examples of such diluents are distilled water, physiological saline, Ringer's solutions, dextrose solution, and Hank's solution. In addition, the vaccine or formulation may also include other carriers, excipients, or nontoxic, nontherapeutic, nonimmunogenic stabilizers and the like. Said nontoxic, nontherapeutic, nonimmunogenic stabilizers are well known to the art, such as glyceryl mono-stearate or glyceryl distearate alone or with a wax. Said suitable carriers comprise those mentioned above and others well known in the art, see, e.g., Remington's Pharmaceutical Sciences, Mack Publishing Company, Easton, Pa.

A preferred further component of the composition is an excipient. Excipients are compounds which may not elicit an immune response when administered to the host alone but which may further enhance the immune response of the host when administered together with the immunogenic polypeptides. It is known in the art that excipients may act as surfactants which promote concentration of immunogenic polypeptides over a large surface area, or may have immunostimulatory properties.

In another preferred embodiment, the present invention relates to a composition comprising Epstein-Barr virus like particles (EB-VLPs) substantially free of EBV DNA obtainable by the method of the invention for use as a vaccine for the treatment and/or prevention of disease.

The term "use as a vaccine for the treatment" relates to the use of the vaccine of the present invention as a therapeutic vaccine as specified herein above. Likewise, the term "use as a vaccine for the prevention" relates to the use as a prophylactic vaccine.

The term "subject" relates to a metazoan organism with the capacity to generate an immune response to molecules foreign to the organism. Preferably, the subject is an animal, more preferably a mammal, most preferably a human being.

As used herein, the term "EBV-related disease" relates to all disorders caused by the infection of a subject by EBV. In a preferred embodiment said EBV-related disease is infectious mononucleosis, Hodgkin's Lymphoma, Burkitt's Lymphoma, nasopharyngeal carcinoma, rheumatoid arthritis, multiple sclerosis, systemic lupus erythematosus, gastric carcinoma, or post-transplant lymphoproliferative disorder. The symptoms which characterize these diseases are well known in the art and are described in standard text books of medicine.

All references cited throughout this specification are herewith incorporated by reference with respect to their specific disclosure content mentioned above as well as in their entirety.

FIGURES

FIG. 1. Construction of the EBV ΔBFLF1 and ΔBBRF1 recombinant viruses.

The left panel represents the schematic restriction map of the EBV genome region that contains the BFLF1 or BBRF1 genes before and after introduction of the mutation. The locations of the BamHI and HindIII restriction sites are indicated. Most of the BFLF1 or BBRF1 open reading frames were substituted against a kanamycin resistance gene. In the case of BFLF1 deletion this led to the exchange of a 7.4 kb BamHI fragment against a 7.5 kb BamHI fragment or substitution of a 29.3 kb HindIII fragment through a combination of a 9.1 kb and of a 20.2 kb HindIII fragments. A 9.7 kb BamHI fragment in the locus of BBRF1 gene was replaced by a 10.3 kb one and a 25.9 kb HindIII fragment was substituted against two fragments with sizes 23 kb and 3.6 kb respectively. The right panel shows the restriction fragment analysis of wild type and ΔBFLF1 or ΔBBRF1 mutant viruses. Viral DNA was isolated from E. coli and producer 293 cell lines and digested with two different enzymes. Restriction fragments modified by the deletion of the corresponding genes are indicated.

Figure 2:
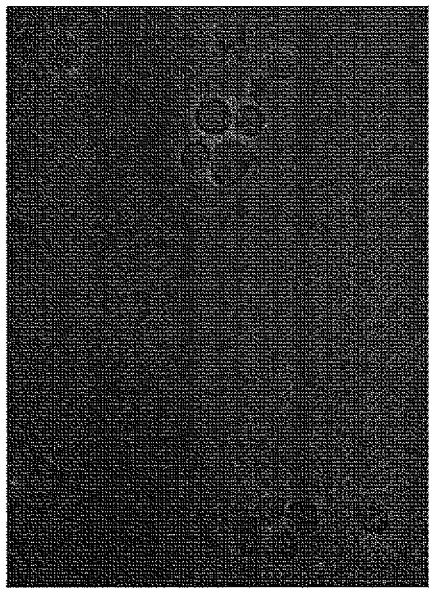
Figure 2:
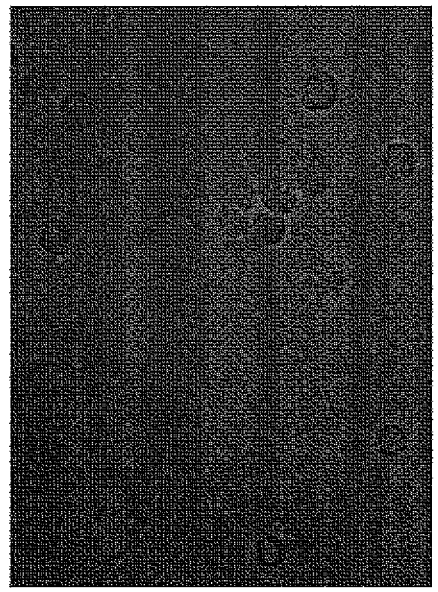
Figure 2:
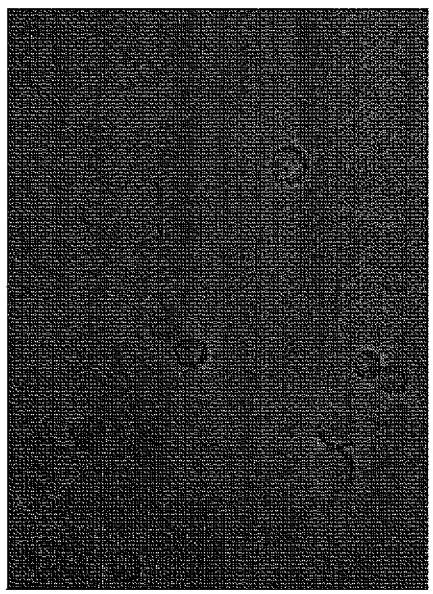
Figure 2:
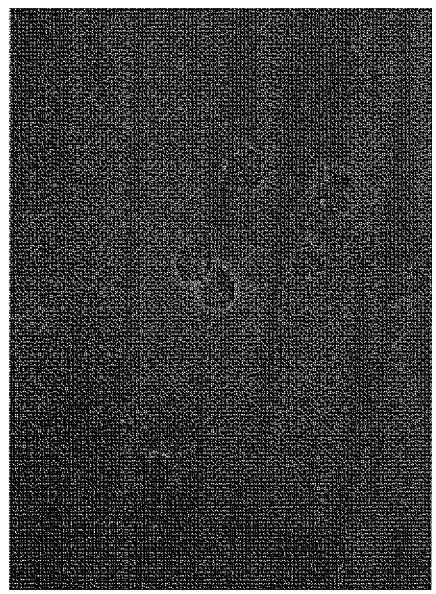

FIG. 2. Immunostaining of VLPs and virions in supernatants from induced producer cells.

Supernatants from producer cell lines containing either wild type viruses or mutants devoid of BFLF1, BBRF1 or of the terminal repeats were admixed for one hour at 4° C. with an EBV-negative B cell line. Viruses bound to the B cells were immunostained with a gp350-specific antibody, followed by a Cy3-coupled secondary anti-mouse antibody.

Figure 3:
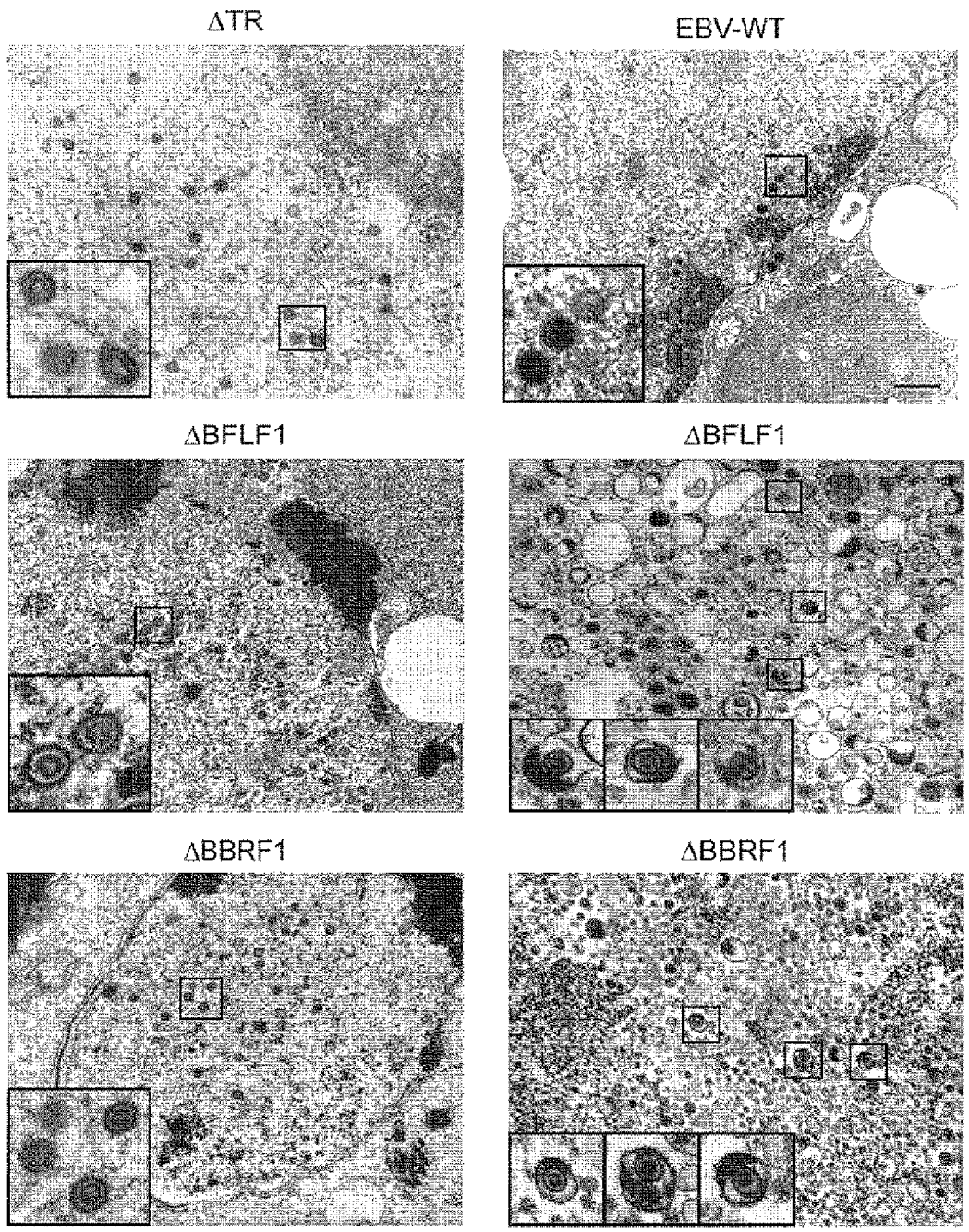

FIG. 3. Electron micrographs of 293 cells that contain ΔBFLF1, ΔBBRF1, ΔTR or EBV wild type genomes.

Electron micrographs of 293 cells that contain ΔBFLF1, ΔBBRF1, ΔTR or EBV wild type genomes after induction of the virus lytic replication, electron micrographs showing VLPs in pelleted supernatants from ΔBFLF1 or ΔBBRF1 mutants. Examination revealed an abundance of A- and B-capsids in preparations from ΔBFLF1, ΔBBRF1 and ΔTR viruses. Infectious DNA-filled mature C-capsids were observed in cells that contain the wild type virus but not in those that contain mutants. Inset bars, 200 nm.

Figure 4:
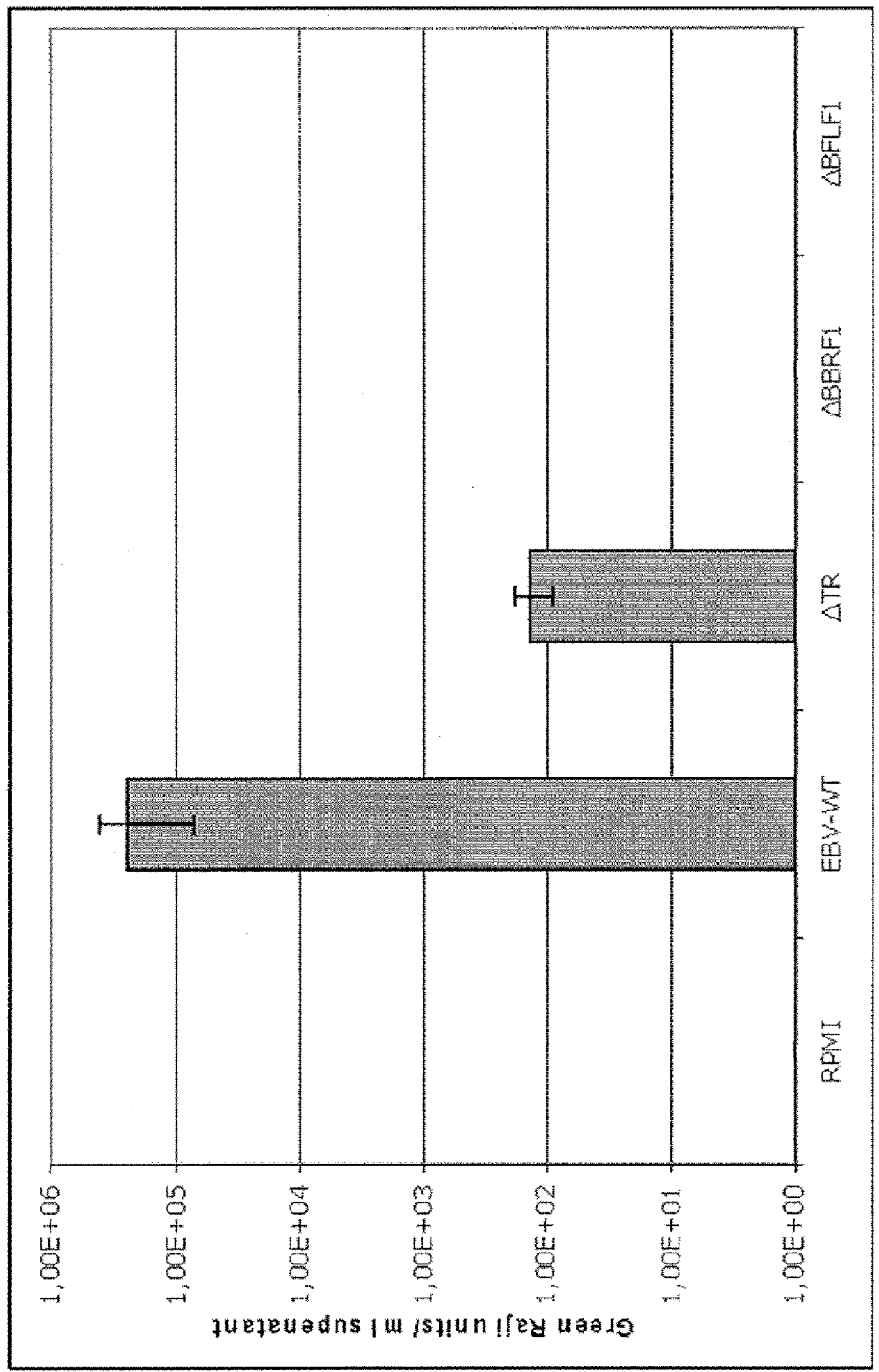

FIG. 4. Infection of Raji B-cells with ΔBFLF1, ΔBBRF1, ΔTR or wild type viruses.

The ability of mutants and wild type viruses to infect the Raji B cell line is indicated. The observed titers are given as the number of EBV-infected Raji cells, or green Raji units, per ml of supernatant.

Figure 5:
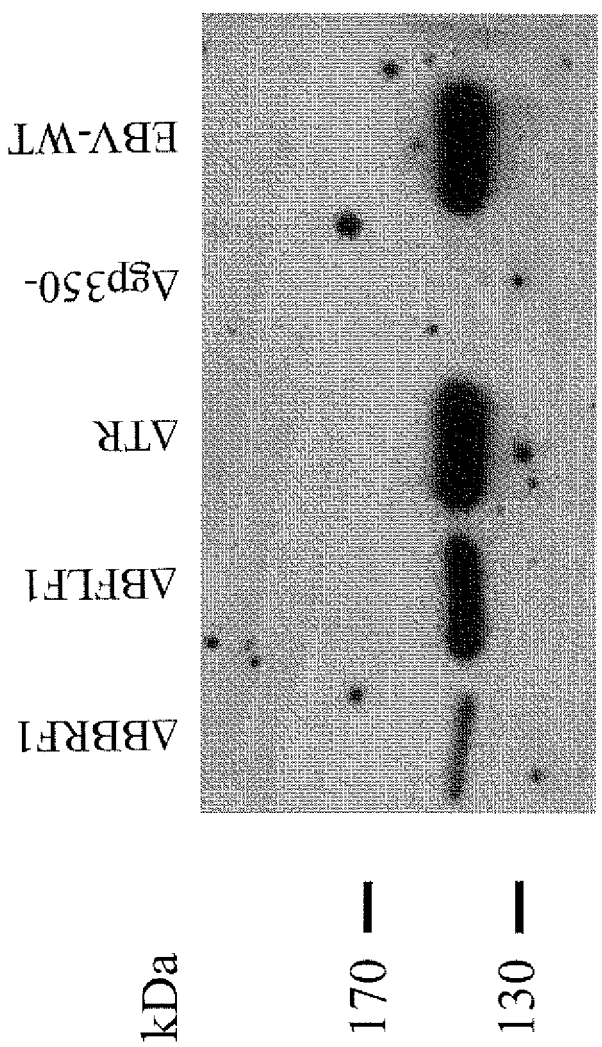

FIG. 5. Western blot analysis using immunopurified VLPs.

Gp350 is a viral glycoprotein present in the viral envelope of mature particles. We used a monoclonal antibody specific to gp350 coupled to magnetic Dynabeads to purify EBV virions or VLPs from infectious supernatants. Supernatants from induced wild type or different mutant producer cell lines were incubated with the coupled beads for 1 h at room temperature. Bound virus particles were collected with a magnet, washed 3 times with RPMI and used for detection of viral proteins or viral DNA. A Western blot analysis was performed on immunopurified VLP/virions using an antibody specific to the EBV tegument protein BNRF1 (140 kDa). BNRF1 was detected in wild type virions, but also in supernatants from induced producer cell lines that contain ΔBFLF1, ΔBBRF1 or ΔTR mutants. Mutant viruses that lack gp350 (Δgp350) were used as a negative control in the purification experiment.

Figure 6:
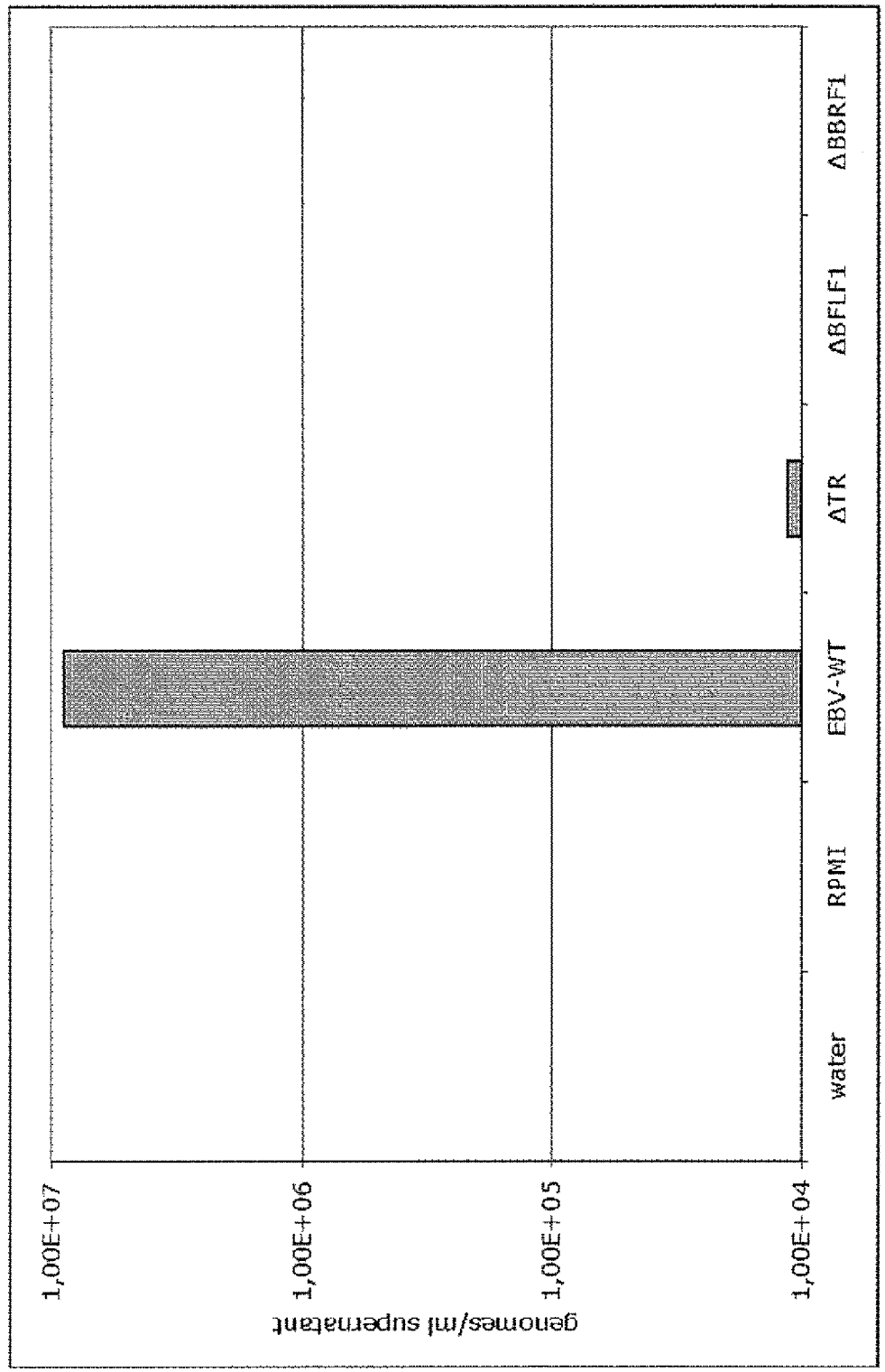

FIG. 6. Quantitative PCR (qPCR) analysis using immunopurified VLPs.

VLP or virions purified with the gp350-specific antibody were assessed for the presence of viral DNA using qPCR with primer and probes specific for the viral polymerase gene. Wild type viruses were used as positive controls. Virus titers are given as genome equivalents per ml supernatant.

Figure 7:
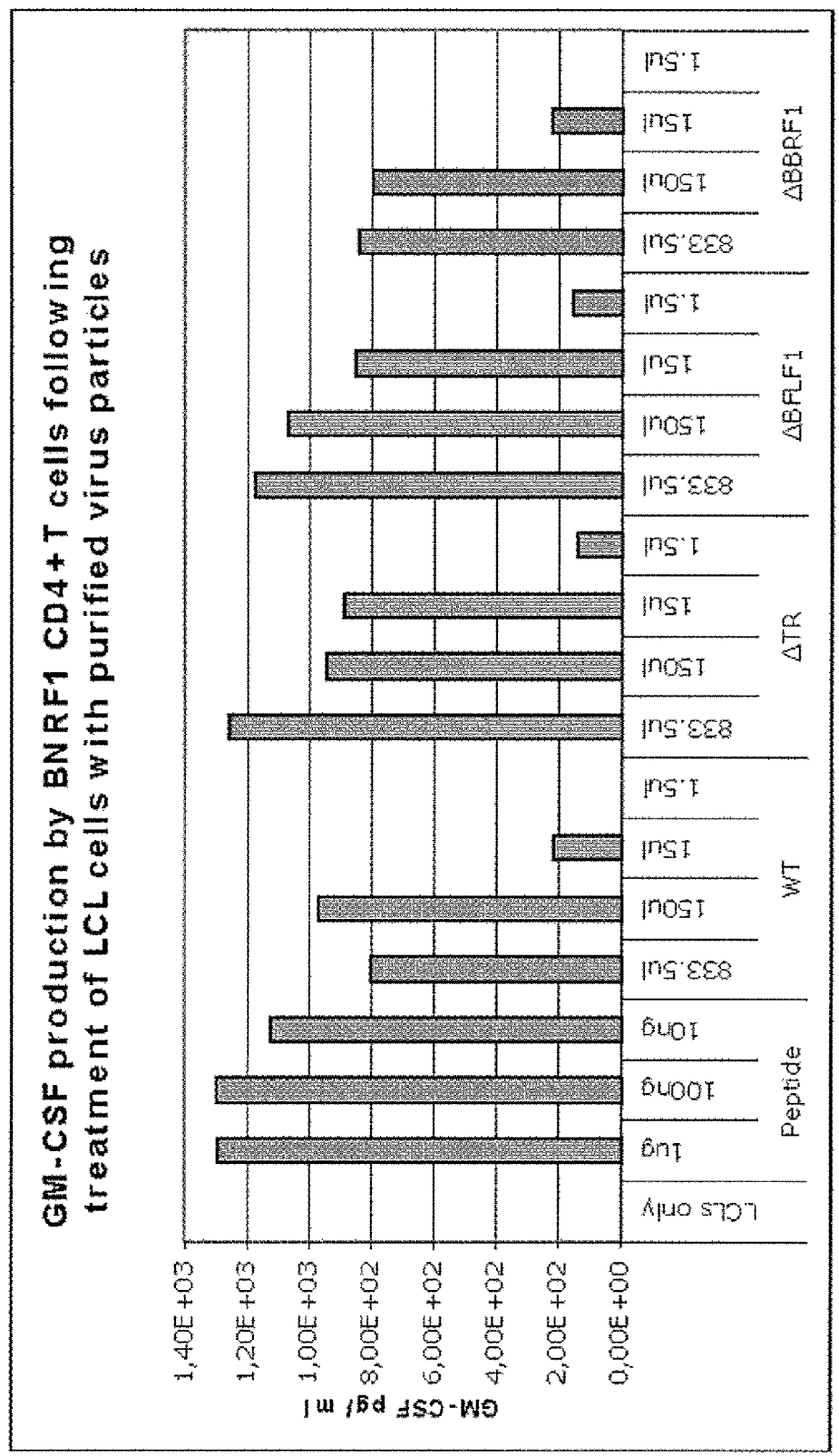

FIG. 7. B cells pulsed with ΔBFLF1 and ΔBBRF1 VLPs are recognized by EBV specific T cells.

Virus particles present in 1 ml of the indicated virus supernatants were purified using gp350 antibodies, coupled to magnetic beads and resuspended in fresh medium. LCL cells were pretreated with indicated amounts of BNRF1 peptide or volumes of purified virus particles. The pulsed LCLs were incubated with BNRF1 CD4+ T-cells and production of GM-CSF was measured by ELISA.

Figure 8:
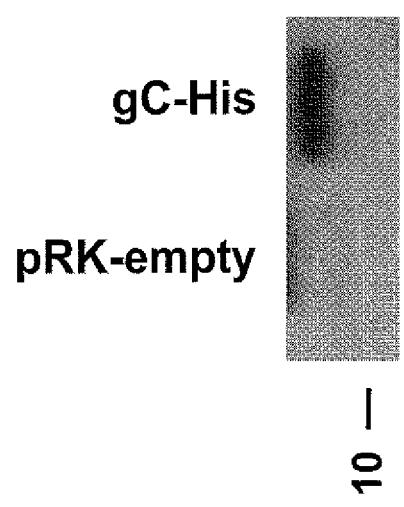

FIG. 8. VLPs can incorporate foreign proteins.

A plasmid that encodes the intracytoplasmic and transmembrane domain of the glycoprotein gC from herpes simplex virus fused in frame with 6 successive histidines (gC-6× his) was transfected into the ΔBFLF1 producer cell line upon initiation of the EBV lytic replication. Produced virus particles were purified using gp350 antibodies coupled to dynabeads and analysed in western blot. Only viruses that were obtained from 293/ΔBFLF1 cells transfected with the gC-6× his have incorporated this protein.

Figure 9:
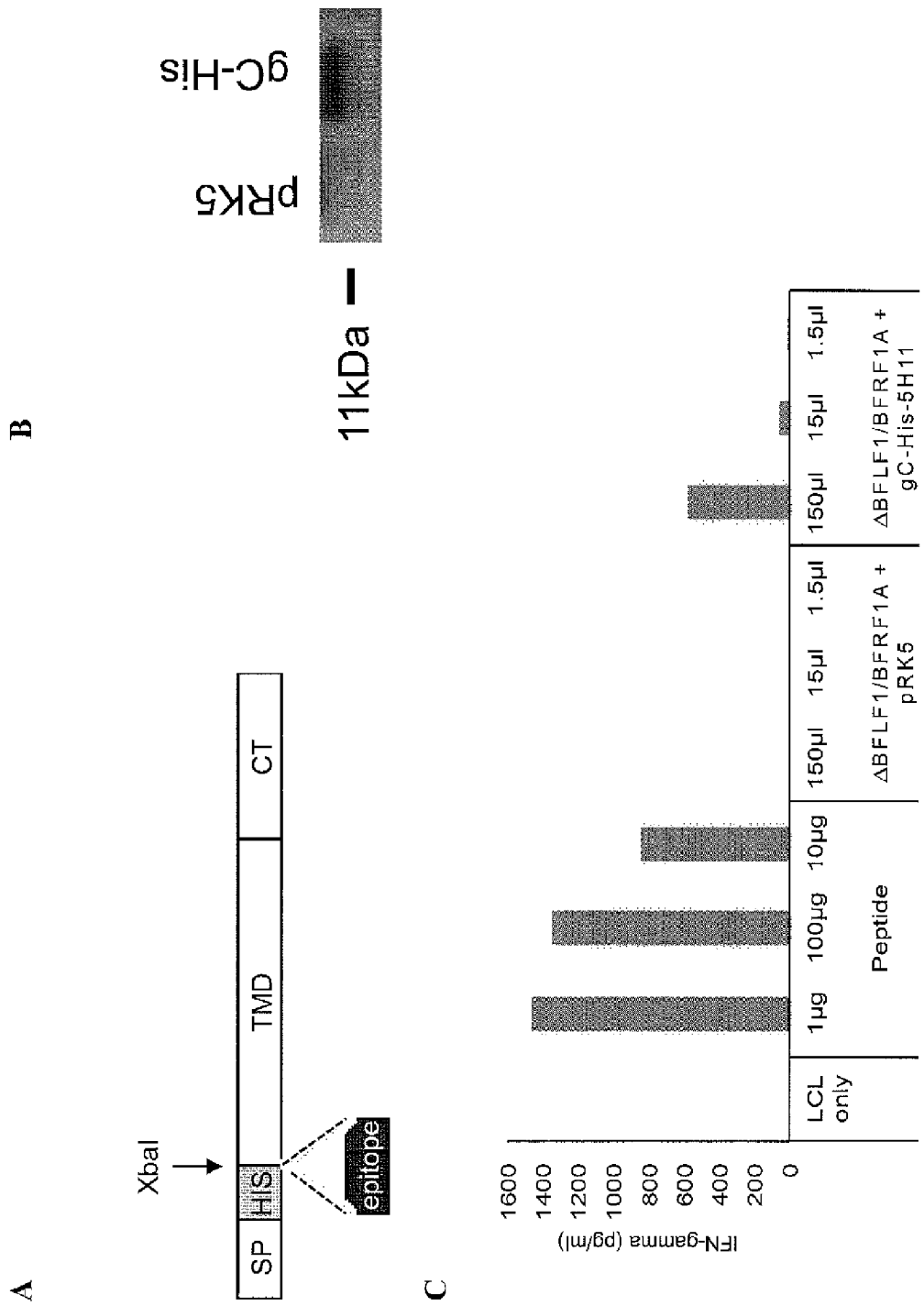

FIG. 9. Inserting gC fusion proteins into the LP/VLP envelope and evaluation of the particle immune efficiency. (A) Schematic of the proposed HSV1-gC-EBV fusion protein constructs. (SP, gC signal peptide; His, His-tag; epitope, EBV T cell epitope; TMD, gC transmembrane domain; and CT, gC cytoplasmic tail). (B) Western blot showing expression of His-tagged gC fusion proteins in LPs/VLPs. LPs/VLPs were generated from an EBV mutant producer cell line that was induced in the presence of plasmid encoding the gC fusion protein, or pRK5 as a negative control. A His-specific antibody was used. (C) EBNA3C 5H11 epitope specific T-cell activation after incubation of LCLs with supernatants from lytically induced mutant producer cells in presence of gC-His-5H11 fusion protein expression plasmid or pRK5 empty plasmid. ELISA was used to determine the IFN-gamma secretion.

The following Examples shall merely illustrate the invention. They shall not be construed, whatsoever, to limit the scope of the invention.

EXAMPLES

Example 1

Construction of the EBV ΔBFLF1 and ΔBBRF1 Recombinant Viruses

The EBV ΔBFLF1 and ΔBBRF1 viruses were obtained by exchanging most of the corresponding open reading frames present on the EBV B95.8-BAC recombinant plasmid (Proc Natl Acad Sci USA. 1998 Jul. 7; 95(14):8245-50. Propagation and recovery of intact, infectious Epstein-Barr virus from prokaryotic to human cells. Delecluse H J, Hilsendegen T, Pich D, Zeidler R, Hammerschmidt W.) (EBV B95.8 strain co-ordinates #57131-58568 for BFLF1 and #114204-116042 for BBRF1 (accession number V01555)) against a kanamycin/neomycin cassette flanked by frt sites (co-ordinates #57131-58673 in ΔBFLF1 and 114501-116042 in ΔBBRF1) using RecA-mediated homologous recombination in E. coli. The viral genomes that properly eliminated BFLF1 or BBRF1 were selected with kanamycin. Candidate clones were analysed by plasmid minipreparation coupled to restriction analysis using the HindIII and BamHI restriction enzymes to confirm their structure (FIG. 1). Sequencing confirmed that the targeted open reading frames had been deleted and that the recombination took place like expected.

Example 2

Generation of 293/ΔBFLF1 and 293/ΔBBRF1 Cells

The EBV ΔBFLF1 and ΔBBRF1 DNA respectively was then transfected into 293 cells and selected for hygromycin resistance; the EBV-BAC recombinant carries the hygromycin resistance gene and therefore allows selection of cells stably transfected with the recombinant DNAs. EBV ΔBFLF1 or ΔBBRF1 genomes present in the 293 Hygromycin resistant clones were purified and transferred back into E. coli cells. From these bacterial cells, EBV ΔBFLF1 or ΔBBRF1 plasmids were prepared to confirm their identity and their integrity. One of each clones, referred to as 293/ΔBFLF1 or 293/ΔBBRF1 respectively were selected for further experiments. Transient transfection of an expression plasmid that encodes the BZLF1 transactivator allow initiation of lytic replication and therefore production of infectious viruses or of non-infectious VLPs. Controls included 293 cells that contain wild type viruses. Three days after transfection viral supernatants from 293/ΔBFLF1 and 293/ΔBBRF1 cells were incubated with cells from the EBV-negative Elijah B cell line (FIG. 2). Because EBV virions bind to B cells, viruses bound at the surface of B cells can be revealed by an immunostaining using antibodies directed against gp350, a component of the viral envelope. This experiment confirmed that supernatants from induced either 293/ΔBFLF1 or 293/ΔBBRF1 cells contain gp350 positive viral structures that bind to B cells and could represent either VLPs or mature virions. Similar results were obtained with a 293 clone that contains wild type viruses. 293 cells that contain a recombinant virus that lacks the terminal repeats, a viral sequence that is used as packaging signals (293/ΔTR) (Proc Natl Acad Sci USA. 1999 Apr. 27; 96(9):5188-93. A first-generation packaging cell line for Epstein-Barr virus-derived vectors. Delecluse H J, Pich D, Hilsendegen T, Baum C, Hammerschmidt W.) was also investigated. We previously showed that 293/ΔTR produces VLPs (first generation VLPs) and this cell line was therefore used as a positive control for the detection of these viral structures (J Virol. 2005 June; 79(12):7641-7. Defective infectious particles and rare packaged genomes produced by cells carrying terminal-repeat-negative epstein-barr virus. Feederle R, Shannon-Lowe C, Baldwin G, Delecluse H J.). We could confirm that supernatants from induced 293/ΔTR contain viral structures that bind to the Raji cell surface.

Example 3

Electron Microscopic Analysis of 293 Cells that Contain ΔBFLF1, ΔBBRF1, ΔTR or EBV Wild Type Genomes Further information about the structure of the viral particles present in the supernatants from induced 293/ΔBFLF1 and 293/ΔBBRF1 was provided by direct observation of both BZLF1-induced mutant producer cells and of pelleted supernatants thereof using electron microscopy (FIG. 3). Electron micrographs either from induced 293/ΔBFLF1 or from 293/ΔBBRF1 cells show that they contain immature EBV virions devoid of viral DNA. Similarly, pelleted 293/ΔBFLF1 and 293/ΔBBRF1 supernatants contain mature EBV virions devoid of viral DNA, ie they represent VLPs. In contrast, 293 cells that contain wild type EBV genomes show EBV particles at various stages of maturation, some of which contain electron-dense cores that correspond to packaged EBV DNA. Wild type EBV virions isolated from supernatants were also found to contain viral DNA. Analysis of 293/ΔTR and their supernatants confirmed that these cells abundantly produce VLPs as expected.

Example 4

Infection of Raji B Cells with the ΔBFLF1 and with the ΔBBRF1 Viruses

In a further attempt to characterize the infection properties of the viral structures produced by induced 293/ΔBFLF1 and 293/ΔBBRF1 cells, we incubated Raji cells with increasing 5-fold dilutions of supernatants from the cell line in 96-well cluster plates, including undiluted supernatant. Three days after infection, GFP-positive Raji cells were counted using a fluorescent microscope. The Raji B cell line is highly susceptible to EBV infection and expresses the green fluorescence protein (GFP) upon infection with the recombinant EBV DNA. Indeed, the GFP gene is cloned onto the recombinant EBV DNA and becomes expressed upon infection of eukaryotic cells. After incubation of Raji cells with one ml of supernatant from induced 293/ΔBFLF1 and 293/ΔBBRF1 no Raji infection could be detected (FIG. 4). In contrast, the same volume of supernatants from induced wild type 293/EBV cells contained enough infectious viruses to generate approximately $2 \times 10^4$ gfp-positive Raji cells. Supernatants from induced 293/ΔTR cells were two orders of magnitude less infectious than wild type viruses but nevertheless generated 120 EBV-positive cells per ml of supernatant and therefore contained 120 infectious particles per ml.

Example 5

Detection of Viral Proteins and Quantification of Viral DNA in EBV ΔBFLF1 and ΔBBRF1 VLPs Gp350 is a major component of mature EBV particles. Viral structures present in supernatants from induced 293/ΔBFLF1, 293/ΔBBRF1, 293/ΔTR, 293/WT were incubated with antibodies specific to gp350, coupled to magnetic dynal beads. Viral structures were then collected with a magnet and the same samples submitted to both western blot and qPCR analysis.

For western blot analysis (FIG. 5), purified viral structures from one ml of supernatant were resuspended in PBS and denatured in Laemmli buffer for 5 minutes at 95° C. The whole sample was separated on a 10% SDS-polyacrylamide gel and electroblotted onto a Hybond ECL membrane (Amersham). After preincubation for 30 min in 5% milk powder in PBS, blots were incubated with a rabbit polyclonal serum against BNRF1 (Feederle et al. (2006), Epstein-Barr virus BNRF1 protein allows efficient transfer from the endosomal compartment to the nucleus of primary B lymphocytes, J Virol; 80(19):9435-43) for 1 h at room temperature. BNRF1 is a tegument protein present at high concentration in EBV viral structures. After several washings in 0.1% Tween in PBS, blots were incubated for 1 h with protein A coupled with horseradish peroxidase. Antibody binding was revealed using an ECL detection reagent (Perkin Elmer). This experiment confirmed the presence of BNRF1-positive viral structures in all three tested supernatants (FIG. 5).

To assess the presence of viral DNA (FIG. 6), the same amount of gp350-purified viral structures, resuspended in PBS was first digested with DNaseI (5 U/50 µl supernatant) at 37° C. for one hour to remove any trace of contaminating free viral DNA. After DNaseI heat inactivation (10 min at 70° C.), purified viral structures were mixed (1:1 vol/vol) with lysis buffer (0.1 mg/ml proteinase K in water) and incubated for 60 min at 50° C., after which the enzyme was heat-inactivated (75° C. for 20 min). This step releases any viral DNA packaged into viral particles. Water diluted samples (1:10) were subjected to qPCR using primers and probe specific to the BALF5 DNA polymerase (pol) gene. Amplification reactions were performed in 25 µl volumes containing 12.5 µl Taqman Universal master mix (Applied Biosystems), 2.5 µl forward and reverse pol primers (2 µM), 1 µl 5 µM FAM-labeled pol probe, 1.5 µl water, and 5 µl purified and resuspended virus particles. Following activation of the AmpliTaq Gold DNA polymerase (10 min at 95° C.), the reaction mixtures were amplified for 40 cycles (15 s at 95° C., 60 s at 60° C.) and the fluorescent signals detected using an ABI 7300 Sequence Detection System (Applied Biosystems). The primer and probe sequences were as follows: reverse pol primer 5'-AGTCCTTCTTG-GCTAGTCTGTTGAC-3' (SEQ ID NO: 29), forward pol primer 5'-CTTTGGCGCGGATCCTC-3' (SEQ ID NO: 30), EBV pol probe 5'-FAM-CATCAAGAAGCTGCTGGCG-GCC-TAMRA-3' (SEQ ID NO: 31). The DNA content was calculated using a serial dilution of Namalwa DNA, a human Burkitt's lymphoma cell line that contains two EBV genome copies per cell, as a reference for the standard curve. The results of this assay are shown in FIG. 6; we found that gp350-purified viral structures from 1 ml wild type supernatants contains approximately 1×10E6 viral genomes. In medium and water controls the qPCR method gives a signal in the range of 1×10E3 to 1×10E4 genomes and therefore we draw a baseline at 1×10E4 genomes/ml. In stark contrast to wild type EBV, supernatants from induced 293/ΔBFLF1 and 293/ΔBBRF1 did not contain any detectable above the baseline EBV DNA. 293/ΔTR supernatants delivered intermediate results as one ml of supernatant contained slightly more than 1×10E4 viral genomes per ml of supernatants. Altogether we conclude that gp350-purified viral structures from induced 293/ΔBFLF1 and 293/ΔBBRF1 contain viral structures that carry the BNRF1 protein but do not contain any viral DNA, ie represent genuine VLPs.

Example 6

B Cells Pulsed with ΔBFLF1 and ΔBBRF1 VLPs are Recognized by EBV Specific T Cells We assessed the ability of VLPs to induce a T cell specific response (FIG. 7). To this aim, we incubated virus particles or VLPs present in 1 ml of the indicated virus supernatants purified using gp350 antibodies with LCL cells that acted as antigen-presenting cell. In parallel, LCLs were pre-treated with indicated amounts of BNRF1 peptide that were used as positive controls. The pulsed LCLs were then incubated with BNRF1-specific CD4+ T-cells. Specific recognition of antigens present at the surface of the LCLs by BNRF1-specific CD4+ T cells elicits production and release of IFN-gamma in the supernatant that can be assessed by ELISA. We found that the BNRF1-specific T cell recognize equally well wild type EBV virions and ΔBFLF1 and ΔBBRF1 VLPs.

Example 7

VLPs can Incorporate Foreign Proteins

Here we show that the intracytoplasmic and the transmembrane domains of the glycoprotein gC from herpes simplex virus can be used to introduce foreign antigens into VLPs. For example, we fused these sub-domains from gC in frame with 6 successive histidines (gC-6× his) and transfected a plasmid encoding this fusion protein into the ΔBFLF1 producer cell line upon initiation of the EBV lytic replication. Produced virus particles were purified using gp350 antibodies coupled to dynabeads. Proteins prepared from these VLPs were analysed by western blot using an histidine-specific antibody. We found that only viruses that were produced in 293/ΔBFLF1 cells transfected with the gC-6× his gave rise to specific signals and therefore have incorporated this protein (FIG. 8).

Example 8

VLPs Carrying Foreign Antigens Induce Immune Responses

Since we have shown that the LPs/VLPs we have generated are immunogenic and fulfil the requirements of a safe vaccine preparation, we aimed to enlarge their antigenic spectrum. EBV infection induces strong T cell responses and T cell epitopes from both EBV latent and lytic proteins have been identified. We chose the immunodominant epitope 5H11 (SEQ ID NO:33; coding sequence SEQ ID NO:32) from the EBV latent protein EBNA3C to be incorporated into the virus envelope. We generated a fusion protein (SEQ ID NO:35; coding sequence SEQ ID NO:34; the construct is comprised on plasmid B599 (SEQ ID NO:37); plasmid B557 (SEQ ID NO:36) is a control plasmid lacking the sequence encoding the 5H11 epitope), comprising the 5H11 epitope and parts of the glycoprotein C (gC) of Herpes Simplex virus 1 (HSV-1) including, the signal peptide, transmembrane domain and cytoplasmic tail. In addition, the construct contained a His tag and a unique restriction site to facilitate epitope insertion (FIG. 9A). Induction of mutant producer cell lines in the presence of this construct led to efficient incorporation of the fusion protein in EBV LPs/VLPs, as demonstrated by western blot of Dynabead-purified LPs/VLPs (FIG. 9B). Furthermore both ΔBFLF1/BFRF1A VLPs with incorporated gC-His-5H11 fusion protein were able to induce specific T-cell activation after presentation from LCLs (FIG. 9C).

SEQUENCE LISTING (38 sequences)

SEQ ID NO: 1 - DNA, 171823 bp, Epstein-Barr-Virus (EBV)
agaattcgtcttgctctattcacccttacttttcttcttgcccgttctctttcttagtatgaatccagtatgcctgcctgtaattgttgcgccctacctcttttggctggcggctattgccgcctcgtgtttcacggcctcagttagtaccgttgtgaccgccaccggcttggccctctcacttctactcttggcagcagtggccagctcatatgccgctgcacaaaggaaactgctgacaccggtgacagtgcttactgcggttgtcacttgtgagtacacacgcaccatttacaatgcatgatgttcgtgagattgatctgtctctaacagttcacttcctctgcttttctcctcagtctttgcaatttgcctaacatggaggattgaggacccaccttttaattctcttctgtttgcattgctggccgcagctggcggactacaaggcatttacggttagtgtgcctctgttatgaaatgcaggtttgacttcatatgtatgccttggcatgacgtcaactttacttttatttcagttctggtgatgcttgtgctcctgatactagcgtacagaaggagatggcgccgtttgactgtttgtggcggcatcatgtttttggcatgtgtacttgtcctcatcgtcgacgctgttttgcagctgagtcccctccttggagctgtaactgtggtttccatgacgctgctgctactggctttcgtcctctggctctcttcgccagggggcctaggtactcttggtgcagcccttttaacattggcagcaggtaagccacacgtgtgacattgcttgcctttttgccacatgttttctggacacaggactaaccatgccatctctgattatagctctggcactgctagcgtcactgattttgggcacacttaacttgactacaatgttccttctcatgctcctatggacacttggtaagttttcccttcctttaactcattacttgttcttttgtaatcgcagctctaacttggcatctcttttacagtggttctcctgatttgctcttcgtgctcttcatgtccactgagcaagatccttctggcacgactgttcctatatgctctcgcactcttgttgctagcctccgcgctaatcgctggtggcagtattttgcaaacaaacttcaagagtttaagcagcactgaatttatacccagtgagtatctatttgttactcctgtttagttgaagaaaacaagctattggattgtaacacacattttacgctttgttccttagatttgttctgcatgttattactgattgtcgctggcatactcttcattcttgctatcctgaccgaatggggcagtggaaatagaacatacggtccagtttttatgtgcctcggtggcctgctcaccatggtagccggcgctgtgtggctgacggtgatgtctaacacgcttttgtctgcctggattcttacagcaggattcctgattttcctcattggtaagtgtgacaccaacaggtgttgccttgttatgtcaccgttctgacacatgacttacatgggtttggcttttgtaggctttgccctctttggggtcattagatgctgccgctactgctgctactactgccttacactggaaagtgaggagcgcccaccgaccccatatcgcaacactgtataaaggtaagtattattaaattttagagacactatcacgtgtaacttgacgtgcaaggatggaagagaggggcagggaaacgcaaatgccggttgcccggtatgggggcccgtttattatggtaaggctcttcgggcaagatggagaggcaaacatacaggaggaaaggctatatgagctactctctgacccacgctccgcgctcggcctagacccggggcccctgattgctgagaacctgctgctagtggcgctgcgtggcaccaacaacgatcccaggcctcagcgtcaggagagggccagagaactggccctcgttggcattctactaggaaacggcgagcagggtgaacacttgggcacggagagtgccctggaggcctcaggcaacaactatgtgtatgcctacggaccagactggatggcaaggccttccacatggtccgcggaaatccagcaattcctgcgactcctgggcgccacgtacgtgcttcgcgtggagatgggcaggcagtttggcttcgaggtgcatagaagccggccctccttccgtcagttccaggccatcaatcaccttgtcctgtttgacaacgcccttcgcaagtacgattccggccaggtggcggcgggcttccagagggcccttctggtggccgggccagagaccgctgacacgaggccggacctccgcaagctgaatgagtgggtgtttggtggcagggctgctggtggcagacagctggccgacgagctaaagatcgtgtccgcgctgcgagacacttactcgggccacttggtccttcagcccacggagacccttgacacatggaaggtgttgagcagggacacacgaaccgctcatagtttggagcacggattcattcatgccgcggggaccatccaggccaactgcccacagctgtttatgagacgccagcaccccggcctctttcccttcgttaatgcaatagcatcatcgctgggctggtactaccagaccgccaccggccccggagcagatgccagggcggcggcccggcgccaacaggcctttcagaccagggcggcggctgaatgccatgccaaaagcggggtgccggtcgtggccggcttctacaggaccatcaacgccacgctcaagggaggagagggcctacagcccactatgtttaacggggagctgggggccatcaagcaccaggcacttgacactgtgaggtatgactacggccactatctcataatgttggggccattccagccatggagcggactgacggcccctccgtgcccctacgccgaaagttcatgggcacaggcggccgtgcagacggccctcgagctgttctcggccctgtacccggccccgtgcatctcgggctacgcgcgccccccgggccccagtgctgtgatcgagcatctggggtccctagttccaaaggggggtctgctgttgtttctgtctcacctaccggatgatgttaaggacgggctcggagaaatggggccggccagggccacgggacctggaatgcagcagtttgtcagcagctacttcctcaaccccgcctgttccaacgtcttcattacagtgaggcagcgaggggagaagatcaacggccgtaccgtcctccaagcgctcggacgcgcatgcgatatggcaggctgccagcactatgtgctgggctccacggttcccctcggtggactcaactttgtcaacgacctggcgtccccggtttccaccgccgagatgatggatgatttctctcccttcttcaccgtggagtttcccccgattcaagaggagggcgcaagttctccggtacccttagatgtggacgagagcatggacatctctccgtcttacgagttgccctggctctcgctggagtcatgcctcacaagcatcctgtcacaccccaccgtgggaagcaaggagcacttggtcaggcacacggacagggtcagcggaggacgcgtggcacagcagcccggggtaggtcccctggacctgccgctggcggactacgccttcgttgcccacagtcaggtctggaccaggcccggtggggctcctcccttgccctatcgtacctgggatcgaatgacagagaagctgcttgtctccgcaaaacccggcggagagaacgttaaggtttcaggtaccgtgattacattgggagaacaggggtacaaagtgtcgttggatctgagggagggaaccaggctggcaatggctgaggcgctgctgaacgcagcatgtgccccaatcttggatccggaagacgtcttgctcaccctgcatctacacctggatccgcgccgggcagacaactcggccgtgatggaggctatgacggcggcgagtgactacgcgcgtggcctgggcgtgaagctgacctttggctcggcctcctgccccgagaccggctcgtccgcctccaacttcatgaccgtggtggcctctgtctccgccccaggggaattctcgggtcctctgatcacgccagtgcttcagaagacgggcagtctcctgattgcggtgcgttgcggggatggcaagatccagggagggtcgctgtttgagcagctctttagcgacgtggccacgaccccacgggcacccgaggcgttgtctctgaagaatctcttccgggcagtccagcagctggtcaagagcggcatcgtgctgtcagggcatgacatcagcgacgggggcctggtgacctgcctggtggagatggccctggccgggcagcggggagtgaccatcactatgccggtggcctccgactacctcccggagatgtttgcagagcaccccggcctggtgtttgaggtggaggagcgcagcgtgggtgaggtgctgcagaccctgcgctccatgaacatgtacccggcagtcctcggtcgagtgggcgagcaaggtccagatcaaatgtttgaggtgcagcacggcccagagacggtgttgcgccagtcgctgcgcctgctgctgggaacctggtcatcctttgccagcgagcagtacgagtgcctgcgaccagatcggattaaccggtccatgcacgtgtccgactacggctataacgaagcactggcagtctccccgttgacaggaaagaatctcagcccacgccggttggtgacagagcctgacccacgatgtcaggtggccgtgctatgcgccccgggcaccaggggccatgaaagcctcctggcggccttcacgaatgccggatgcctgtgccgacgggtgttctttcgcgaggttagggacaacacgttcctcgacaagtacgtgggtctggccatcggaggagttcatggggccagggactctgccctggcaggccgtgccaccgtggcgctgattaatcgtttccccgccctgcgtgacgctattctaaagttcctcaacaggccagatacgttctcggtggccttgggggagctgggggtgcaagttttggctggcctgggggccgtggggtcaacagataatccacccgcccctggcgtggaagttaatgtccagagatcacctctgattctggcccccaacgcctctggcatgtttgagtcccgctggctgaacattagcatcccggcgaccaccagctctgtcatgctgcgtggcctccggggctgcgtcctgccttgttgggtgcaaggctcgtgcctgggcctgcaatttactaacctcgggatgccatatgttttgcagaatgcccaccagatcgcctgccacttccacagcaatggcacggatgcctggcgctttgctatgaattatccaagaaaccccacggagcagggcaacattgcagggctctgttcacgcgatggtcgtcatctggctctcctgtgtgacccctcactttgtacagacttttggcaatgggagcacattccccccgcctttgggcaccccacggggtgctccccctggacacttatgtttcaagcagctcacctatggtcactcaggcacggtcgcccctccgagtgaccagtcaccttccagactatgcatacactgaatttagcctgatattgtccccctagccccgggcccagccctcctcagaaaactctgcatggagaagctggacgtgaacctcccccccagacctgtgtgctgtatttacaaacactacaataaacccaatgtgcaaatgtggtttgtatggctactttgtgttcctaaaaaatgcaacaatagaagtggaaaccctcagtcacgggacattaacctcaaccacaaaatgggggttggagaaagtaaccacatatactggagatgattcatgggctgggggttcccggacaatacacccatctggagttcaacctaattacatggtagataaattaagagtccctcctcaccactcgaaactatggcagacattctataagataacgaggagagatgaggtgagggcagaggacattgggcaggtgtgggccacggggcagctggccatatcccccgcactacagaagtgtaagcaaagtgaagggctcggaaggcaggcggggcctagcaatgtcacagctaaatgcccaccagggcacacactcaagcggggtctcggagctcctaggtcagaccacgaaaggtcagcctgcaaggtggatggcgtgttttctgaggttatccccgctacgtgcagtgctgggtgatagagaccctagaatgtgtcgaaatgaccaagcgtccccgcagcggggctcccaacacgggttcccagagagggtaaaagagggggccataaagcccagggtgtaaaacaccgaccgcgccaccagatggcacacgtgggggaaatgagggttagcataggcaacccccgcctacacaccaactatagcaaaccccgccccgtcacggtgacgtagtctgtcttgaggagatgtagacttgtagacactgcaaaacctcaggacctacgctgccctagaggttttgctagggaggagacgtgtgtggctgtagccacccgtcccgggtacaagtcccgggtggtgaggacggtgtctgtggttgtcttcccagactctgctttctgccgtcttcggtcaagtaccagctggtggtccgcatgttttgatccaaacttttgttttaggatttatgcatccattatcccgcagttccacctaaacggggcttaacgttgcatcccagaagatgcacgcttaaccccgcctacaaccgtgacgtagctgtttaccagcatgtatagagttacggttcgctacatcaaacaggacagccgttgccctagtggtttcggacacaccgccaacgctcagtgcggtgctaccgacccgaggtcaagtcccgggggaggagaagagaggcttcccgcctagagcatttgcaagtcaggattctctaatccctctgggagaagggtattcggcttgtccgctatttttttgtggctagttttgcacccacaacatgtaagggcccgctacccctacaacacaaaacaaactatctcccctaaccatccttttgccaatcaattctgtgacagggtttcctggacacccagtcttagttcaggtagacacccagttatgcagtgccaccaattccaaccatttttaaacctcctggaattctatcattaaacggcatgcaggaaaaggacaagcagcgaaaattcacgcccccttgggaggtggcggcatatgcaaaggatagcactcccactctactactgggtatcatatgctgactgtatatgcatgaggatagcatatgctacccggatacagattaggatagcatatactacccagatatagattaggatagcatatgctacccagatatagattaggatagcctatgctacccagatataaattaggatagcatatactacccagatatagattaggatagcatatgctacccagatatagattaggatagcctatgctacccagatatagattaggatagcatatgctacccagatatagattaggatagcatatgctatccagatatttgggtagtatatgctacccagatataaattaggatagcatatactaccctaatctctattaggatagcatatgctacccggatacagattaggatagcatatactacccagatatagattaggatagcatatgctacccagatatagattaggatagcctatgctacccagatataaattaggatagcatatactacccagatatagattaggatagcatatgctacccagatatagattaggatagcctatgctacccagatatagattaggatagcatatgctatccagatatttgggtagtatatgctacccatggcaacattagcccaccgtgctctcagcgacctcgtgaatatgaggaccaacaaccctgtgcttggcgctcaggcgcaagtgtgtgtaatttgtcctccagatcgcagcaatcgcgcccctatcttggcccgcccacctacttatgcaggtattccccggggtgccattagtggttttgtgggcaagtggtttgaccgcagtggttagcggggttacaatcagccaagttattacacccttattttacagtccaaaaccgcagggcggcgtgtgggggctgacgcgtgcccccactccacaatttcaaaaaaaagagtggccacttgtctttgtttatgggccccattggcgtggagccccgtttaattttcgggggtgttagagacaaccagtggagtccgctgctgtcggcgtccactctctttccccttgttacaaatagagtgtaacaacatggttcacctgtcttggtccctgcctgggacacatcttaataaccccagtatcatattgcactaggattatgtgttgcccatagccataaattcgtgtgagatggacatccagtctttacggcttgtccccaccccatggatttctattgttaaagatattcagaatgtttcattcctacactagtatttattgcccaaggggtttgtgagggttatattggtgtcatagcacaatgccaccactgaaccccccgtccaaattttattctgggggcgtcacctgaaaccttgttttcgagcacctcacatacaccttactgttcacaactcagcagttattctattagctaaacgaaggagaatgaagaagcaggcgaagattcaggagagttcactgcccgctccttgatcttcagccactgcccttgtgactaaaatggttcactaccctcgtggaatcctgaccccatgtaaataaaaccgtgacagctcatggggtgggagatatcgctgttccttaggacccttttactaaccctaattcgatagcatatgcttcccgttgggtaacatatgctattgaattagggttagtctggatagtatatactactacccgggaagcatatgctacccgtttagggttaacaagggggccttataaacactattgctaatgccctcttgagggtccgcttatcggtagctacacaggcccctctgattgacgttggtgtagcctcccgtagtcttcctgggcccctgggaggtacatgtcccccagcattggtgtaagagcttcagccaagagttacacataaaggcaatgttgtgttgcagtccacagactgcaaagtctgctccaggatgaaagccactcagtgttggcaaatgtgcacatccatttataaggatgtcaactacagtcagagaacccctttgtgtttggtccccccccgtgtcacatgtggaacagggcccagttggcaagttgtaccaaccaactgaagggattacatgcactgccccgcgggaaatacgtcctacccaggaacccgaaacagtgtttcccagaagctgtaaaaatagaacgccctggaactgccccactgtgcaatgcagcttttagccatgccatgctctataaatcacttccctatctcaggtaggcctgcacaccttaggtatggagcgaaggttagtggtcactctgcagtgcctggtgctgctttacctggcacctgagtgtggaggtacagaccaatgtgacaattttccccaaatgttgagggacctaagagatgccttcagtcgtgttaaaacctttttccagacaaaggacgaggtagataaccttttgctcaaggagtctctgctagaggactttaagggctaccttggatgccaggccctgtcagaaatgatccaattctacctggaggaagtcatgccacaggctgaaaaccaggaccctgaagccaaagaccatgtcaattctttgggtgaaaatctaaagaccctacggctccgcctgcgcaggtgccacaggttcctgccgtgtgagaacaagagtaaagctgtggaacagataaaaaatgcctttaacaagctgcaggaaaaaggaatttacaaagccatgagtgaatttgacatttttattaactacatagaagcatacatgacaattaaagccaggtgataattccataccctggaagcaggagatgggtgcatttcaccccaaccccccctttcgactgtcatttacaataaaatgaaaccttttattcttgattgcctcttgtgttcttgccgcccaggtaccttcctgtgttctccccacgggaaaaagaatagcttctgcagaaggccattgacgcaagttttgcccgtggggattacccgacccagccacttacagcacattttgttctaggtccatcttaggagcccgggccagcattctatcagcttaacgggaagagaagtggggagggcactcgcccactaaccttaacacctgcagcctacaaaagtacactagctgtttgctctattcgccactagagaccgccaagatgcgaaactacaggcccgggcccaggccttgcagggcagacggttaggctgacaaggggacaagtgtggcaggtgggcgggaaggggcacaagaatgccggcgaaactggaccacggtccaccccgccctcaagcgtccgggagccgggcggctcggctaaggagggcggccttgcgaacaattattagtagctaccaacaagggcccccagatgccccccaccagtcacccggccgtgtccactcacatattccactcttatttttaaattaatgtgtcccaattagaaacccaagcgcagaaattagttgagaggctagtgttttaaacatgcaccctaggccagccagagataatgtcacaagattatcaagttggtgtaaacacgccgtgggaaaaaatttatggttcagtgcgtcgagtgctatctttggaacagtagaaaattgaaccttgttggcgggagaaggaataacgccttatctgggaggagcgacggattatagccaataagagagctcaagacgcagggctcgcaaagtatagtggccccgtgggaccttagaggtggagcaacgtctaaagtggtaataacaccaggcggggctgggcaaaggggtcctacgggcgggattaattacgccttgcttacgcaagctcagttaattcgcccacgacttgaaaaatgtagcccttaaccaattggcggcccctaagggggggactaaggtcccactacaaaaactctgtgttctgctgcaaattttagatcagatggcatagagacaaggacaccgaagacccccagagccctcatcgcagggttcttaccatgcggccatgtaggcccacttaacactacaagacctacgcctctccattcatcatgtaacccacaaatcatctaaaccgtaagtctaagggcctcctgaggttttctcaggaggccctaatgtataattaatcatgcatttgattttaaaaaagtaggttacactcattttaggccagactttatttgcagattaataatttatgtgattctccttccctctaggactgaagaaacagcctcctgcacgtgagcatgtatctgaaataattattatgtcataagtgtaatgattagaaagtcataaacccacttccctttacatgaatctgggcactgaattttggggtacttctaaagactaacgtgttcgatttcggggtcacttccccttttataagtgtgtgaacagtgatttcagtaaaacctaagagatatttggtgtcacttccgcattttaagtttcagaaaattttaaaattaaaattgaaatttctctcaaaataattccaatgaaaacttcaaagaatcttatgtatgtaattcttttgccccaaactgggcttcagatgccttctattgcactctcacaaaaacattctggacacatgtgccagacgcctgggcctctaaggccctcgggtccccctggaccccggcctcagcaaccctgctgctcccctcctgccaccccagcctccccccctccccgtcccccttcgctcctgttcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctctcgcccaagctgctttgattcctgggatatttttgggaatggtgttaactttctccccttgtatttgctattcaatcaacctgattccccctgctcatacctccacttacaaccaagccactacggccacgtccccggcctcccgctcgggtaagtgctttttcatttttagccccagcccctcctctataagttctaggcaaacctccaatcaccagccaccttccaatgtagtctcttagagagtggctgctacgcattagagaccactttgagccacccacagtaaccacccagcgccaatctgtctacatagaagaagaagaggatgaagactaagtcacaggcttagccaggtgatttgtgaatttcagtttatttactttcttccaatcaagctttcccagcctccgcttgttaggtcctagttatgggttttccatgggggacttagtatccgttctattagattaacgtgcaagacgctaaacttaaccaaggtcagccaagggacgcgtgttatcccaggctgcccaccctgaggatttccccccaaaatcctcctaccctctctttatgccatgtgtgttgttggcttgtgttagtgctatgtaatgcgttgccgccaggtggcagcctgtttatagatgtgcagtaccccttaatgttaggtctgctttagggctgccaggtggcgcaatctaggattaattcacctgtatccctttccctccacccgcagtaacccagcactggcgtgtgacgtggtgtaaagttttgcctgaacctgtggttgggcaggtacatgccaacaaccttctaagcacccgcgcttgtgttttgctttatctgccgccatcatgcctacattctatcttgcgttacatgggggacaaacatatcatctaattgttgacacggatagtcttggaaacccgtcactctcagtaattccctcgaatccctaccaggaacaactgtcagacactccattaattccactaacaatctttgttggggaaaacacgggggtgcccccaccactcccaccaccccccccaccaccacccccaccacccccaccacccccaccacccccaccacccccaccacctccaccaccttcaccaccacccccgcccccaccacccccaccacctcagcgcagggatgcctggacacaagagccatcacctcttgatagggatccgctaggatatgacgtcgggcatggacctctagcatctgctatgcgaatgctttggatggctaattatattgtaagacaatcacggggtgaccggggccttattttgccacaaggcccacaaacagcccctcaggccaggttggtccagccacatgtcccccctctacgcccgacagcacccaccattttgtcacctctgtcacaaccgaggcttacccctccacaaccactcatgatgccaccaaggcctacccctcctacccctctgccacctgcaacactaacggtgccaccaaggcctacccgtcctaccactctgccacccacaccactactcacggtactacaaaggcctaccgaacttcaacccacaccatcaccaccacgcatgcatctccctgtcttgcatgtgccagaccaatcaatgcaccctcttactcatcaaagcaccccaaatgatccagatagtccagaaccacggtccccgactgtattttataacattccacctatgccattacccccctcacaattgccaccaccagcagcaccagcacagccacctccaggggtcatcaacgaccaacaattacatcatctaccctcggggccaccatggtggccacccatctgcgaccccccgcaaccctctaagactcaaggccagagccggggacagagcagggggaggggcaggggcaggggcaggggcaggggcaagggcaagtccagggacaagcaacgcaagcccggtggaccttggagaccagagccaaacacctccagtcctagcatgcctgaactaagtccagtcctcggtcttcatcagggacaaggggctggggactcaccaactcctggcccatccaatgccgcccccgtttgtagaaattcacacacggcaacccctaacgtttcaccaatacatgaaccggagtcccataatagcccagaggctcccattctcttccccgatgattggtatcctccatctatagaccccgcagacttagacgaaagttgggattacatttttgagacaacagaatctcctagctcagatgaagattatgtggagggacccagtaaaagacctcgcccctccatccagtaaaaacccttgccctctccagcaaccaatgtatcccaaataaatgttacttcttttgctcttaaccattgacacgcctgtcattctatcaattaaacaagggaaaaaggtttagctattccaccaacacgaccccaaggaaggcttgccaaaattggtgccttgctctcagcactttgccagcaacttatagcatggtaggcagctcaactcggcccgtcttactgcccagcctactctccactcccagtccatgttcgcactcctatgcatttcctgccctcccacttttaccccagtcccaacccaaaaccacacacaacacatagaattgttagtttaaacagtttattgataggtggctgcttttagcctaattgtgtattgctctcgttgccaaaacctgttgtaagggccggcacccgcaacatggggaaaacataaccgccgccatcccatggggagggtagaggcggttgacatgtaggtgagtagtgtaagaagcatggcgaagtagacaggttacttttagagtgtagtgtacagggccgggcgcaacagtgccaccaacccggggtctgagcattccatgggcagcagggacactgcactaccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccactgcacctggaatgcagggtgggggcgtggtcccctggaccccagccccgccgatccctcccccagggcgtacccggcttgcctggttctggggctcctctgggggtcgctgcatccgccggtagggttcgaatgggcgtggtccgcttgctctgctggcccggtacgcctggattgccggctgggggctggggtcccgggacgccccctccctgctcccacccggttccctcccccagggcgtgccccgcttgcctggtcctggagctcatccggggatgctgcatccgctagtccgacctgggtgggtgcggtccgctggccccaccctgggggtagccgccgggtctgctggtccggtgcacctggaaggcaggggggggggcagtgagggaggggcgtggtcctgggaccccgcgccgactggcagggggtccccatggcacaggcctaggggtccagggggcagccgcggcccagcgcgccccgttcacgggggaggaccgcggccgagccaccaggggcccggcgggggtggggggtgcgctcccaggccggaccctggtgccaggcagggaccccgcgccacccgcttcatggggggggaggccgccgcaaggacgccgggccggctgggaggtgtgcaccccccgagcgtctggacgacgctggcgagccgggccggctcgccttcttttatcctctttttggggtctctgtgtaatactttaaggtttgctcaggagtgggggcttcttattggttaattcaggtgtgtcattttagcccgttgggtttcattaaggtgtgtcaccaggtgggtggtacctggaggttattctattgggataacgagaggaggaggggctagaggtccgcgagatttggggtaggcggagcctcaggagggtcccctccatagggttgaaccaggagggggaggattgggctccgccccgatatacctagtgggtggagcctagaggtaggtatccatagggttccattatcctggaggtatcctaagctccgcccctatataccaggtgggtggagctaggtaggattcagctaggttcctactggggtacccccctaccctaccttaaggtgcgccacccttcctccttccgttttaatggtagaataacctataggttattaacctagtggtggaatagggtattgcagctgggtatatacctataggtatatagaacctagaggaagggaaccctatagtgtaatccctcccccccctacccccccctcccttacggttgcctgagcccatcccccaccccagcaccccggggtgacgtggcaccccgcgtgccttactgacttgtcacctttgcacatttggtcagctgaccgatgctcgccacttcctgggtcatgacctggcctgtgccttgtcccgtggacaatgtccctccagcgtggtggctgcctttgggatgcatcactttgagccactaagcccccgttgctcgccttgcctgcctcaccatgacacactaagcccctgctaatccatgagccccgcctttaggaagcaccacgtcccggggacggaaggggacttggggtgattttctatgtgggggtggaaatatgagcaagaataaggacggctccttattaacctgatcagccccggagttgcctgtttcatcactaaccccgggcctgaagaggttgacaagaagggtcaaggtttcgtctgtgtgttgaagggcaggggctgttgggtgcatctggaacggcttacctcgggtaactgtttgccattaaaaggttggggattaggtttagcccctttagctgccatttcgaaccggggtgtgcagatgcaggtctccgggtgggcaggcagtacgagatgtcacgttgtgttgtctttcctcccacccctgtcctggctgtggcaaatgcgaccctcatagagttgtgtttcaggtctgtgtcctgttttgcggtgggttatttcttccctcagtgtttgccagcttatttccccagttttcacgtactggggcctgtggacacctgagggagcggccgttggtgggtatgtgttggaattgctcccaccctcaattttcgcttgccttcttcccttgttaacctgatagcatagcctctaggtttccttgtaggtctgtttgggtttgttggttcacgtggtgctaacttgaattttttggttttctagttccctcttaattacatttgtgccagatcttgtagagcaagatggcctattcaacaagggagatactgttagccctgtgtatacgggacagtcgtgtgcatggaaatggtaccctgcatcctgtgttggagctagcagcaagagaaacacctctccgcctttcgccagaggacactgtagttctgcgttatcatgtgttgcttgaggagataattgaacgaaattcagagacatttacagaaacttggaacagatttataacacacaccgaacatgtggatctggattttaactcagtatttttagagatatttcaccgtggagacccaagccttgggcgcgcgttggcctggatggcctggtgcatgcatgcctgcaggacattgtgttgtaaccagtctactccttactatgttgtggacctgtcagttcgtgggatgttagaagccagcgaaggcctggatggttggattcatcaacagggcggctggtctacattaattgaagacaacattcctggatccagaaggtttagctggactttgtttcttgctggactgactttgagtctgttagttatatgtagttatttatttatctccagaggaagacactaatctatacattttctcagcactttatatgaatcagggtcattgggcctgcggggaactgagccagtaggatattaggcaagggtgacacagtgcccatgcattataatttaaccaaacagtggtcgtgagttttaggccggccatgggggcttacaagaataacatgccaatgacccggcccccacttttaaattctgttgcagcagatagctgatacccaatgttatcttttgcggcagaaattgaaagtgctggccatatctacaattgggtgtcctaggtgggatatacgcctgtggtgttctaacgggaagtgtgtaagcacacacgtaatttgcaagcggtgcttcacgctcttcgttaaaataacacaaggacaagatactaaagaaataactgaggtgagtgtgggaagatgggaatactatgtgttatgttaacgggtgagagcctatactgcagcccagactcggggggaggaggaaatggtaagagttatactctacttatcttttttgacactacatttaactgttatgtaacaatgtttgcttattttcatgttcaataaacgctatgttaatgatgaagaacctgtgttctttggaagtgggcccaatggggtagtaggttttgggagggtgccgtgctagatatttcaactgccacagaccccattttgtcccacctgttaccacattctaggtcctgcatccagtgggccaggtgtctcaccatggctctttctaggtggataccacagtccaggcccccaaggctaccgtgctaattacctcctcatgtccacccccaccctgtgttactgtcgcctgattatcctggcttagcagcctccaagttttacaagacgtcccattgccctgcccttggtccaagtctcgccggttttcagcagcctgttgtagcctgcccccaagtttcgcaggtttcccccatgcttccacccgttaacccaatagcatgacagccaatccaacacgaggcaagttttaagagttaaaagcaactactgtttattttccaaaatgagctgggtatagttgatgatctgtaggcgcagctcatccccacattccaggtccttgatggcctcgtagatggcatcttcgtcgacattgacagccttctcatataccgtgtctctggggctgacctttatacagaaggcgtcccctactaggtccacggccagctcgtaggtggggcctatgttttcacataacagtttcaagcaggtctctgggatgtgaagggaggtgccctggagcaggagatgcatgattaggcgcccttttccatttgtgctgaagatggggcagatggtgccacaaaagtgtccggtgaccaggtaagcgtagagaaggctgggttgggaaagtccagcctttactgcactgggagagctgctgagcagagacacatagaaggtcttgttgggtattatcttgtggacattgttgaagaaggagagctgggtggagctaaactcctgaggcacatgaacctgggacctattgatgcagatctcgcagtgagaccccagagtcaggctgtggccgaagggagacaggcgaaggcagcgcccgggggagagagtgcacagtgacagtgggagaaacacggcctctgagacatgtatgggggtgttcatctcacgcagaaaatctttgcccagctcaaagttggcagagattcccctgaagaagtcccgtagtgaaaaatgggatctgtctacaccatgtctggtgtgccgggaacatattgatcgggccacactgccaaccctttccattcttcccagctctgagcgagattttccacacctggacaccgacttcacgctatgcgccgaggcctttgaggccgtgtagtttctgtggtgcggatgcattaggcggcgcaatgcgggatctgccggtcgctgttggcgtgcattcacggcatctggggtgaccggggccatcgggtttacttttcacacgtagacctgggaagtttgataggactgtaccaggtcaaggccgtggatgcgcaggaccacgtccagttccttagtgacatccacgaggattgttttgcccactctggccacttgtgtggatttaaatatgtacacaagcgtaattaacgagtcacagaccccctgttccagattctgaccggctgcaagcgctgccttaaaggcctggaagctgggtgggtaaatctgaccaaacagcacgctcggattcgtgatgctgtggttgatggcacacagggggtcgcagaacaggtgcttgtggaagtcttgcggggtgcacatctgcagccaggcccttagcctggggcatggcacatccagcagcgtgttttgggtcttgatgaggaacacgatcctgtctaggattttgatgttgttgccgaacgagtcaagaatcaggctcttgaagcggtcaagggtgtccttggcgtccgggtgggccccgaggctctcgcagagtgggcagatggtccgtgaggcattcttgtgccttagtccaaacatgggggccaggaggcaggggccctgcgaatggtcgccagcctccggtctggtgatggccagggccaactccgccagctcatcgccgctgtattccgcgtttaaaccgatagcatggtggcctggccccccgagcaggtccgtcccctgccacgtacctaatagtagtccacagtagtcggccttggttgtaatttcaggagagagtcctcccttttcggccctgagaaatggatgctgaactcggtttctggtaggcaggtggcagcacagggcggtgtacaggcccctgccgacgtcccctgggacatcctgggaatctttgcaggttctgggtccagggagggtaagaaaagtgggggtggttctgggccacatggacttgaagcagaagttggccggggactggccggtgaggatggatttcagaaactccaatttgtagtagccgaggttggcatttctaatcatgtcagaagaggacacagggaggaagcaccggcaaatgtaaaagtgaagctggatgtcaatggcaagaatcctggagggcatgaagagggaatccaaccccccggccatggggaagtattttatcaggatgtgtaaaaagtccatgcctgtgatgaggctagagatccaggctcgtggggcatttagacagtagtagcagagcagggcatagtcctcaaagaaggccacgggggcatctgagtgattgaccagggtgtcgagcagatcacaaactcggcaggtgctggctggagagagggactcgtaggtgtggacgagtggtgggtaggctatgccttcttccgcgttggctggaagataggagtgggccatcaaaaggccgactgcctcgaactggcttttcagattgtccacggtccagggcacaaagtcctccatctttggagttctgcccgcgatctgtgccacctctgttacgccactcctcgtgagggggcagctggacagtctttttccggtcagggggtttggctcgtttgcgctcgtgactttgtgagccatgacacatctgggtggcaaggtgaggtcttctgggtttttaataccggggtcggcaccagtttctgggacaccgccacaaggacaaggtgggctagcaagttctcgagtctacgaagactccgggggcagtcttttgagtttctcgcctatgatccaccccaatctcgcccccctaattgcgccatctgcctacgcgaggctgaacctcctgaatcactgcatctttcttgaggcgtttaaagaagagaatagtggccagggcctcggtggggtccagcgtgaggtcttatttttgaaaagggatattataaaacaggtcattgctcggattgtggcagccgatagcaccctagatctagtgaatcatggcgagcccggaagagaggctcctagacgagctcaataacgtaattgtgtcatttctgtgtgactctgggtctctggaagtggagagatgctccggggcgcatgtgttctccaggggcagctcccaacccctctgcaccgtgaagctgcgccacggacagatttaccacctggagtttgtctacaagttcctggcctttaagctgaagaactgcaactacccctcctcgcccgtgtttgtgatatccaacaacggcctggccaccaccctgaggtgctttttgcacgagccgtcgggtctcagatcgggccagagcggcccttgcctgggtctctcaacggatgttgacctaccaaagaactccatcattatgctgggccaggatgacttcattaagttcaaaagccccctggtcttccctgctgagcttgatctcctgaaatctatggtggtctgccgggcctacatcacggaacaccggacgacgatgcagtttctggtgtttcaggccgccaacgcccagaaggcctcgcgggtcatggatatgattagtgatatgtctcagcaactgtctcggtctggtcaagtcgaggatacgggcgccagagtcacaggtggaggaggtcccaggcctggcgtcacgcactcggggtgtcttggggactcacacgttagggggcgcggtggttgggacttggataacttttcagaagctgagaccgaagacgaggcgagttacgctccttggagggacaaagactcgtggtcggaatccgaggcggcgccgtggaagaaggaactcgtgaggcaccccatccgcaggcaccggacacgcgagactcgccgtatgcgcgggagccattcacgggtggaacacgtgccccccgagacccgggagacggtggtggggggagcatggcgttattcttggcgcgccacaccttatctggcacgggtgctggctgtcacggccgtggccctgctcctgatgtttctgaggtggacctgacgttgcaggcccttggggagcgggggttctccaggctcctggatctggggctggcctgcctggatctgagctatgtggaaatgagggaatttgtggtttggggcaggcccccagcttctgaggcggctgtggcctctacgccaggctcgcttttccgaagccactcgtccgcctactggttgtcggaggtggagaggcccgggggccttgtccgctgggccaggtcacagaccagcccctcatccctgaccctcgcgccccatcttggcccgtccctcttgtccctttcagtggtcaccggtggtgggtgtggagccgtggccttttgcaacgcctttttcctagcttattttttggttgtgcggtctgttttccccgcgttttccgatagaatagctgcctggatctgcgaccggtcccctttctgcgaaaacacccgggccgtggccaggggttaccgaggcctcgtgaagaggttcttggcattcgtgtttgagcgtagtagctatgacccccccttgttgaggcaaaactctaggcctgtggagcgctgctttgccatcaagaattatgtcccgggcctggactcacaaagctgtgtgacggtcccgagcttctcccgctgggcccagtctcacgccagcgagctcgatccccgggagattcgcgacagagttacaccagcgactgcaccttcgttcgtggctgatcatgcctcggctctattggcctccctccagaagaaggcctccgacaccccctgtgggaatcccattcagtggatgtggtaccgcctgttggtaaactcgtgcctgaggagtgcccactgtcttctgcctatacctgccgtctctgagggggggagaaagacgggcgggggcgtaggggaggagctcgtgggggccggggggccctgcctgagccgggatgttttcgtggcgatcgtaagccgcaatgttctctcgtgtctgctgaacgtgcctgccgcgggtccccgggcctacaagtgtttcagatcccacgcctccagaccggtgtctggcccggattaccctcccttggccgtgttttgcatggactgcggttactgcttgaactttggaaagcagacaggtgtaggaggcaggctcaattcctttagacccactctccagttttatccccgtgaccagaaggagaagcatgtgctgacctgccatgccagcggccgtgtgtactgctccaactgcggctctgcggcggtgggctgccagaggctggctgagccaccgagcgcccgctcgggctggcggccccgaatccgggcagtgctgccgcacaacgcggcctacgagctcgaccgtggctcccgcctcttggatgccatcatcccctgcttgggacccgaccgcacttgcatgcggccggtggtcctgcggggggtgacggtcaggcagctcctgtatttaactttgcggacagaggccagagccgtttgctccatctgtcagcaacgccaagctccagaggacgcccgcgacgagcctcacctgttctcctcctgtttagaggtagaattgccacctggtgagcggtgtgcgggctgccgtctctatcagacgcgttatggcacgccggctgcccaagcccaccctccaggggaggctggaggcggattttccagacagtcccctgcttcctaaatttcaagagctgaaccagaataatctccccaatgatgtttttcgggaggctcaaagaagttacctggtatttctgacatcccagttctgctacgaagagtacgtgcagaggacttttggggtgcctcggcgccaacgcgccatagacaagaggcagagagccagtgtggctggggctggtgctcatgcacaccttggcgggtcatccgccacccccgtccagcaggctcaggccgccgcatccgctgggaccggggccttggcatcatcagcgccgtccacggccgtagcccagtccgcgaccccctctgtttcttcatctattagcagcctccgggccgcgacttcgggggcgactgccgccgcctccgccgccgcagccgtcgataccgggtcaggtggcgggggacaaccccacgacaccgccccacgcggggcacgtaagaaacagtagagggcacgaaacatggtgtatgcactttattaataaacaattacagatacaaaaacttgagtctctcgaggtctgcgatgaggcggtgggtggaacgctccagcttgcggcgaagctggctcacgaagcgagacagtactcggctagcctgactaagggtgaggctataacgcaggtcctgttccggggcggcggtggatagagaggagggggatccggaggggaccactaggtcgccggaggtcgaccctcctgtcaccacctccctgataatgtcttcaatagacagaaattgggtgaccactgagggagtgttccacagtaatgttgtctggtcgctagatggcgcgggtgaggccacgctttgcgaaaacgaaagtgcttgaaaaggcgcgggatagcgtgcgctaccggatggcgggtaatacatgctatccttacattttggcattttgggcagctgggaggcggcggatgggggtgcttcttttcgcacggtgtatgtttggggacccgcatgccggtactgggataggcgcacctcgggccgcgcgccaggctccgagccggaatgcattgggggcaatgggattgcgggggattgttgctgtctgctcctgacagggagagacacgcgcggcggagatgcagccgacggcggggccgcggtgggctgcccccgaggacgggcgccggccgccagcgcccccgtggcctttggcacgggcctggcacccaccgctttaattgtgggggtgggcagggcagctgcatcttggggcctttgtgcttgcgttttttgggggcgcggtgccaatgcaccaactggggtgtgcgccggggcggccaagccggaccccagggcgggtgcctgggggatgggaaagccggacggcgcttctcccgggtcgaacgctggagtagcggaggctgctgcgccggcggccaccacgggcgcacggggtcgcagcccgacggccgtggggaggcgggtggcggagggccgaatctccgcggcttcttcccggcccccctgctgtttcttctcccgttgcatgatagaatggccatagggtgggtcctgagaggaggcttgtgtgtcctggggctggagcccaaaagtcgttaaagatgccgctgatggtgtgggagctatgcctcccgtcgactggccgggcttgtagggggctgagggtggataactgggcttctgtgaaggcaccaaccctggaatctggatggtatgtttcttctgtgaccccgaggcagtcgatggtgtagagtgtggagacaatgtgtagacgatgggcccttgttcagaagcccagggacttgaggggggctgttgtggtgctggttggggaaggagctccagggaatctttgggccatggccttggggagcttcccggagaccggtctgggctctcggaagccctcgtttcggccccgaaatagggccttgccatcaatcgggggcctgggagagtgatgggggcggccaatcccggggtaactgtcacgtcccggggggaggaggtaggagacagccagtccctgggcctgccaggggccaccttctctaagagggggctctgtgggctgggagggccagaggcctcagattcagcagtagtgctccccttttccccctggtccgtctcccctcctcccaactgctggagccggtcggaggaggccggggtgttatctgctgactgaaacccgtccccgctgaccagtccgtgccccacccttggggggaaaccggagaacagctcctggacgttgcgtggattcgggggaagctggtatccaaccggcagtggaggatcttcgtgctcgtagaaggaggggttgagtacatcggtcggccatcgtgaggccccggccgcgttaaagtagaactgcacgtccggcagattgtgccgataggtgaaacacttccagatgatgttttttctgttggccaggatggccacggtggggggcctggcctccttaggtttggcggccctggcctcggtgagaagctcgcgtagccacacggcctggcgtgcaaagatggacatctctggctcgaaagactcggagtagccgtccaggtcctgcagaaaattcagcgagatggtctccaccagggaccggaagggctcagagtgcccgtcgcagtagaggaggggagcaacgaccctgacctgtcccagggtcttcaggttaaacagatattgagaggagacaaagagagttaggggccgaccgaggaaggccgccgccacggccgcctcaaaaacggagacggggatggtgtcaccggagcccctcttaggaccggtaatgggagtgccataaggcataagatttctcagggcccggccggtaacggtgccgtaggaagacggggtttcgcgggggacctcgagtccctccgccctggggagctcttctccgcgtgtataggcctgcttcacaaagtcgcgcaggtagtcctgaaatgcgaccgggccctccagcgggcgcaatgagtgccagagctgctgaagggcctcgggggcgaagcaccggcgtgcgaggagcagcatgcaggctcgggcgcgggccgtactttggttgtggaccaggcccaagaactcggggtgcggccagagggcggctcgggtatccatctcctcccaggcgtcctggaagaagatgaagccggtgggtggaccggcgatgcggtggcgggtgaggcggcgcgcgtcttccccgtcgttgctgccgcgggtggttgagggcatgccccccctcccggaggctggactcctgaccagcctgtaggtgaggaccgagtccgacaggaggtctcccaaacccccatctctcgctagagccgagaccaggccgagtcctgcgtagaacgatggggcgcccaggaaggcggcagcgtaggccggatgtgtgccgaccagcagcgccatcatctcccgttgttccaatagaataacttcccggtctgtggccggggctggataaggggggtgattcctagaggcgatgagactggcgtgcgctaaaagtgtcatggccacaatggggttgtctgccaggtcttccatcagggctttgggcgcagagacgtattcccgaagcagctccccggcgttggactccacgtcgggccaggtgtcccagtaggagtcggcggcggcggcgctgaggcgggcggaagctacactggccagggttcttctcctcctctcttggtcatcctgcgggggaccaatagcttgggggcgtccggctggggtcagggaaaaggcctctgggttctccagcacggtgggcatgacatattccagaaagttgtggtagacggggatgtagttgagcggctcctgggtgtctgcggagacgtaggccgggttaagggggtcgcagggagactctgtttccagccagagggtgccggcgtatttcgccggccctgccgccgccagaaattgtgcccgccgggtcggggctccattgccccatccagttggtggtgccgaaatcgtgatgaggaggggcaggttgttggtcaagggatgcttaacgaaaacggtaggctgggcggtctcgtaaaaagccaggaaactctgcttggccgaggcatagcgcagcagcttgtccttgaggagggcatactgggagccagccgaggccccaagcgccaggcccctggcagcctccaccacgatcttgagctggcgcgggtcggtgtggcccctggcctgggtgaccagatcctgcagcgttccctgcagctgggactcttcctgggcctcctggatgatggcctccagtcgggagaggcgccttttccagtctgcgacggtctccttgccccccgcgacccgcttggggtccaacgtggccagagccaacctcagctcctccatgccatccatggagttctgggccatgccctcgacttccaggagccgtgttagctcatgaatttcaccgtcagccgcagcggctaggttcagccaggcacccgcgcccccagctaaggccagggctccttcggaaagaccccgcacggcctcgcagatgccccggatccacttggcggctgccagggatttccggtagggccatgagccgttcccggccgctgcccgggccagggcggcctcgaggggagcctggacaggggctttgggcggggagggaagcaggctccggagttcatcgtcgggggcttcgtcgcgtgacctggagaggacggcctccagagccgtgtgaaagccccgccgagtgcttgccgccatctcgtgggccttcgccatcagggtctggctctcccggacctgctcttccagcgcccggacctcggccgcctcggcctcggtcagcagctccgagaagaagtcccccgtggcctggaggagatcgtcccgctctcgccttgtcagcagctggggcttcttaggccagagcgccgagtccgaggccagcctgggcggggcggttgcctgggggatagttggaggaggaggcaggttagcctggcctgggtcattagtggcttcgggtagcgtccgatccacgtactcgctcacgatggccgtcagggcagcctcggctgctcgtcttttttccagaagcccggccagcccccgctcgtactccgcgtagggggcctccagatccgtgttgaccaccgctgatttcatgtccggggactgcagggcctggcgcgtctgcgcgagggccgaacggatggcatcggccgccgtcctggcgcgaaagagggccccggccgcttcctccgctcctcgccctcctcctccttctttggcggtagccgcgggggtggcgggccaagcgtccagtctggccagagggccggtctcgatatccgtgaaccagccgggttccgcggcctccattctctccgccgcaccaccatcgtccacgagcagggatcgcagtctctccctcctcaccctcgttattcccaatagcatagcggcaaggatctgtgtgagggagtccaagatgtccgtgtttctggctactgccgccgctgctgccgcggctgagtccgtattgtctggcagcagggaggccagcagggtgttccagtcatcgggcgaagtgggagcgggctctgggcgtgcccccagcgccttcctaattctggcccaggcctcattcgcctctcgcgctcgccgctcctgcctctccttgtcttcctgttctcggagcttctccttttccttgcgcccggtctccataagctgccgcagcttcttctcatactgtcgcttgagctctttgttgggggcagtgtccagaaaggcctcgagctgttcctcggtggcgggcttaaagccttcggcctccaggcgccaggcctgcacctccttctgtctgagctgatcgttgttgttattcttcaatttctgcaggtaacttaggaagcgtttcttgagcttccctgggatgagcgtttgggagagctgattctgcagcccagagagtagtctcagggcatcctctggagcctgacctgtgatcgtcgcatcatagaccgccagtagacctgggagcagattcaccgccgcggccgtctcctttaaggtgctgtgagtagcaaaattctgcaaggccactaggcgcgctggctccagcgtcagccggttgcccatctcgaatgtgtgcagggcctctgagaccatggggtccaggatgcggtcaatgccatcctgcacctcagggtcaaggaccggcaagtcacgatagaggtggtctatgctctcctcgaaggaggcaatgtagttatcgatggtgtagaaggtgatggatttcaggatgttcatcaggtactttttggagcgaacaatctgctgtatagtgtcacgtaggcggatgtacgtggggttctttgcggccccgactatcgaccctgcatttgcgatgtacttttctatgacggggatggtgagggccgcggtgtcggccagcggtggcgtggcttcggggttgtcgtggttggcgggtgtcgcagagggagaggcgggagagatgggggcgcctggggccgaggccacaccggccaggcccaacattgcctcgatgtcgtccaggatggtgcggaggcgcttttcgttttctctggtggtctcgagctccttctgttttttcgcgactgtctcaaactctggaaggggggcaatgctggggtcgtcctcctcaactcgctccaggggccaggggataccgctcatatcactaagggcggtgcccaggtagaggagctcgcgatagtcccattcaatggacgtgtaccggatgtttaggagaggcagggaggcgatgatctggcatgtgtgccgcaggtgtgtcaggaggtcgtcaaaatccatcactgttgggaggcttgggtcctcaaggtaggagagataatcggaggccgccgaggccaccttgtccctgatgtccgccgtacacctgcgcacgtgcagggccgcattcttggaccggacggccacgttgtggacaaaggggggcactgaggcggcgggaggggccccatactctatcgctgtcaacagcgccaaaaagcggacgtcctcctcatctaccccagcctgttgtctggccacggccgttcgggcggcctccgccagggataggaggcgcttccagctttcgtcgtccaggaccaaggggacgtccacgtgcgggcccctgtagatggaattatcctcgggttctcctcctccttcccccgcctcctgatctccgcccgagagcaggtcggtcaggcgtctgcgggccgcctccaggtcaaattttccatcgtcgctctcggccagctggggaatttcagccagcatcttagcaccggcatctacacggaccgcgtccttcgtggccagggacggcaggcaggcctccagctttgcggccaggtgcttatggaactctcccgctcttcccttgttttctgatagcatgtttgcgaggttttggatgttaagttcggaagtgagcagttgctccaggtccagcgtggggacctgcagatgtcccgaccagtcctttaagaattccagcagatttagcacagacgatcggtccctactccttattagcccctgctcgaggaccactgtcacaagaagatagtctatcatgctcaaggcatctgcctctggcacttcccggttagaggccgggtcgtagacgatggcctgttcctggtaggtatgtccggctattctcgcaatgttgctctcgaggggcacaaagtccatctcaggagtctctatgtcaaaggtggtctgatagtattggctcctggcggtgtccagtgtgatgggggacgtgggggcactggatcccgattccaggctgttggagaacacttcatcttcgaacatgtcttcatcctctgtggtggggatatcggaggctaagtcgctctccgcttcttcagagtcggacatggataggaaaggctcctctaggtcagacaggtagcggacgaggccagaacccccagatgcatcatccccaaaggagggctgctgcccgaagggaggtgatggggatatctccgttccagccctgtcagcggccgggggatggtttttttctggttcgagtgtcgtggctgatggtgggagctgctgagcaggaggaggagccggggtagctgatggcaggggctgctgctgaggaggaagaggagaaggagcccgggcggctgatggcgggggctgctgctgaggaagaagtggagaaggagccggggcggctgatggcgtgggctgctgctgaggaagaagtggagaaggagccggggcggctgattgcgggggctgctgctgagttggaggaggagaaagagtcgtggtggtgggggctgctgctgcagtcggggaaggggatggggtggtcagagggatttttgggttcgagggagctgcctgtggcagagggatgggtatttgcaaagggaggcgaggagatggagtgactgaaggagcgatagttgagactggcgcggggtggggtgtcggggaggcgggtggtgattggtgagggatggggattactggagggggaaggcgagctgctgaaggggggcgatggggcggaacgtgggtgcgtggcagctgatcatcctctgtgtcagtggtggaggacagagggaggcggcggccggaggtgggcttcttgtgggggctatctttgcccaatccctttttcctcttgggagtctgaggcgctgcgccgctcgacgcccttggtggcgtggagggagcggggaccccgggggtgtgacctaggccggggatggggatgaagaggggagggctggaggccggggccgcggaggccggggccgcggaggccggggccgcggaggccggggccgcggaggccggggccgcggaggccggggccgcagaggccggggccgcagaggccggggccgcagaggccggagacgacggcggggagttggtctttgcaggactatacctggcggcagggaatgagtcggatgtgaaagatcgagagggcagtggcctgaggttatacggtattattcgccgttcaaacggtagcatgacgggagggctgctatcagcaccgggcgtccccgccgcctccccatcactggacacaagctcgggccccaccaggtcaaagccgctgccgttggcctcataaaagtcatacacgccatagtgttccagcataaagatgcgggggtcctctgtctcaaaggcctcgggtagaaaatagagatgcacgcaagtgtactgggcccctggtgcccccacgtactgcaggatgtcgtgcgcataggtgctgactctgacatgggcgggggtgcccggggccgcatccttctggcagtgggggtcaaacaagtagaaggagccatctgtctcgatgatgatggcccccgcgtagatgtcgcagatgtagaggatgaactgggccaccccgttgtaactgccgtgcaggacctcggccagggactgaacaactgccgagtttgcgatctgggcagggaataggacgaggccaaagatctccgccgagcggtatatgtgcacgcgcccaccgcccctcaggaccacggagctgggcacgtccgtcaactgggccatctcgtgccccttgaggatgccgctctggcgcatgagggcatccagccgcgccccctcgtccaggacctcgtccagctcagggcgggaggtcagggggcggccggccaggaagctcttgaccaggtagaggacgcagttgctgacgcactggatgccggcaaagcggccaaacttgcagtgggcctggttgcacgaggccgtgcctaggatgcggagggccgagcctccactcccgcccccgggggcattcacatccatggtcctgattccgcgcacggggccggttccccgggtgcgctggctttgcccccagtcgccgttactcatcttcggcggtggggcggggaggacgccttgtcgccccccttctggtccggggtcttacgcggctggcggcggcagccgccgagagataaggggggtacgtgtgtgcctccgcctctcctctgtctgggccgccgccgccgcttgcccgccttgaaggagagggggtagtccgcggactgcgtctgcgggggcaggaggtctcaaccttctgggctcgggccgcggtgtcgatatccgatggcctttccctgtcttcctcgtatgctccttctcctcctcctcccggcacgcccctgagatctgcctcccctccctctccctcgtcctggtcggaaaagtctgaggaggagaaggagaatggggaggagtccaaaacggcacgccacctgccgtggggcggtggtgacaggtcccggctggcccggcgcttgctcgcgttcctgccgttacccaggagaatggccgcgagttttttggcggggaggatgcggaatggcgggggcgtttgtcccacgggtgagggggaatcgtcggttagggccggcacgaggtggtgggtctggacccgggccgtgcgagcaaaggcggcgagaaccgaggggcttctgggggtgactgtgatctgttccggatttaggtccatggcgggtgtgtatgttttaataggggtggtctctggcgcggcaggatgatggtcgaggacgtccaccagggccttgcagatgctcttgcctagatacaggatgtcgtccatgctgaggggaggtggggtgtctgctcccccctgcggaagccgcctgggtgcggggatgaagacaggtggtgggcgggcgtctcgccggactatggcctcggcacgctcggcgtcgatggcgggtggctggaacaggcgggcgaatgtgtaatcccggaaccggtaggcgacgctgcgcctgagggcgcccgtcaggctgtatcccagctccagggcgtgctccacccgctcgttgagctcctcgagatccggacgcaggggctcgctggtgtgggcccagagggggtgatccgcgatgccccggctctccctgagggccggcaccaggaggcgccttctgagggtggccgtgtcggccgtggccagggcccacctggcggcggcgtcccggcacacatcctggatgccctccacgacgctctttagcgtctggaggtccgtggagtagtggcggggggaggatgaaacgctcttttccttcaccgctaccaccgcctcctcctcctcttccgtcgccagagggatctgcaccctcccggtctctgcgtcgtacaggagcgggcgggagcacagcctccaagctgcccccgtcaagcgcgagatgtcctccgagagggtctcacccgagaccagaaagcggcgggtggccaggcccaacgactccgccgtcgtgctgtatctcagggtgaagaggagtgaaaagagggaggtgggccaggcaagcggtggtgcttccgccgcccgctctgaagctgagatagtctcggagatgatgcctgagacctctcggacggcgtccatgatcctaaggactgcgtcgtgggacgacagcccccaggggcccccgccctcttcgtcttctgcaccctcggctcctgcgtccccggccttgccttccccctctaagttgagggggcgcagtccgaccgcctggggggactccccaggcatcggaggggccccgtcatagatctcccagacggtggcgtatatgagctcgagaggacggcgggcccgggtcagctcgggggaagggagggccaggtcgctgccgaaggagaccagccagcgcagggcggccagagagcgggttttgggcagctcgttggagaggacccggcgaagggcgggccagatttggaactcgatgaaggcggccgggaagaaggggctgtggacataggccggatccgcgcgcgccgtttggccggccctcagggaccggcagtatgcctcgacgtctgtccgcggggccgccgccaccgctgccgtccactgccttcttccctgctcgccggggagtagggggggcttacaggggagggccggagccggggccggggcctgccacaggcggctgtagcggacccatagcagagacctgaggagttcggatgaaaggtcccccgccacctgctcatactcggccgcgggaggggggacgatgaagatgcgcagaggggttacggcgtcccaagggtccgccgccgcccccacacccacagccgtcgcggcgggggcggcggcgggcgtagaggggccgctggtgcgccgggctcgtctgtccacggcctcggcctccgcccgcaggtaggccgcccgggccacacgggcgaagcggctcgtggggctcgcggtgggcagcagtcggaaaaagtgcagggcaaagcccgatagactctctaggagggcggcggtggcctcgagccacctccaccgcgagcgggacacccggggcacagaggccagcatcatggcgtagtcccccgccacggtctcgttgagcccggccgagagcagaaccgtggccacctgctcgatggcggctggagagaaggatgcccggctccccgccgcctcctgcacacgagcggccagggcctccatctctgccgccatcccggccaggaaggcctcgatgaccgagtctgggacgccgtaagtctggtcccagagcagggcctcgtacacatagtcgtaaaagagggcccctgagggctccaaaagccggagccgggcggcgtcaaaggccaggacgggcacagccgcgacggggggcgtttgtcccccgctggcctccgcgtacacgcccaggatctctaccgcccgccgccgggccaggggcagcgaggccaccacgctggaaagtgactcggggcggtgaaagagaccaccaccgctttcttcaccctctcccccgccggccccgcccccactgtgctccaccagctccacggccatggccttgatgtccgcggccgtgggctgaccctgccctgcagccgcccaggggtagcggttggtctccgcgtatacggtgaccagccatctccccagcgtcgttttcgccgcgttaaaagcgtagaatgacagcccctcccgcgggaaggcgtcccaccgggccagataagtgtcggccaccagctcttccacgaaggcaaaggtggccgttgggccagagaccgcgagcacctccccgctgccctcttcgatgatgcgccggtacgcggccgccagggcccgggtctctgcgatgagccgagagccgtccagcggatcgtcggtggccggagaggctgtcgtggggggcagtgaggatgccagcacgtccagggccgcctccagatggccgaggccgaagctgcgcctggaaaaggaggccgcccggagtaggtagtaggcgtggtggcggaggaccgccgccgggtaagcgtggccgctcatgagggtgagagtatttaaaaaatcgcgcaccagcaccggctgggccaaatcccccagtccaaagatccccagctccagaggcatcagcgcgcgcaggcgggcagcggggtcgtccccagacagcagcaactgacgcgtcacgcgggcgagccccccgtccacctctgccaggggtggctgggcgtctgcccctccgctaccgccgctgctgtcactctccatagcggacgccatgaaggtccaggggtccgtcgatcgccgccgtctgcaacgccgaatcgcggggctgctgccccctccggcccggcgtctaaatatttcccgggggtccgaattcacgcgggacgttcgtgggctggttgaggaacacgcgcaggcctcctcgctgagtgcggcggccgtctggcgcgcagggctgctggccccgggggaggtggcggtcgccgggggtggcagtggaggggggagcttcagctggtctgggtggcggccgccagtctttggggactttctgatacacgccagctccttcaacaacgccgaggccactggaacgccccttttccaattcaagcagagtgacccgttctcgggcgtcgacgcggtattcactcctctctccctgtttatcctaatgaatcacggccggggtgtagccgcccgggtcgaggcaggtgggggcctgacgcggatggccaacctgctgtacgacagccccgcaaccctggctgacctggtcccggactttgggcggctggtggccgaccgccgcttccacaacttcatcacccctgtgggccccctggtggagaatataaagagcacctatctgaataaaatcaccacggtggtccacgggcctgtggtcagcaaggccatccctcgcagcaccgtcaaggtgacggtgccccaggaggcctttgtggatctggacgcgtggctctccggcggcgccgggggtggcggtggagtatgcttcgtcggggggctgggcctgcagccgtgccccgccgatgcgcgcctctatgtcgctctgacctatgaggaagccgggccgcggtttacgtttttccagtcgtcccgcggccactgtcagatcatgaatatcttaagaatttattactcaccatccatcatgcaccgctatgctgtggtccagcccctacatatagaggagctaaccttcggggcggttgcctgtctggggacatttagtgctactgacggttggaggaggtctgccttcaattaccgtggctctagcctccccgtggtggagattgacagcttttattccaacgtctctgactgggaggtgattctctagacttaacgggaggaaacaggaggaggagggggacaagagcacaaaagtggttcagtggacacccaccacacagcatggcaacgaccagtcatgtcgagcatgagctcctctccaaattgattgatgagttaaaggtcaaggccaactcagaccccgaggctgatgtcctggccgggcgcctgctccaccgccttaaggccgagtcagttacacacacagtagccgaatatctggaggtcttctctgacaaattctacgatgaggaattcttccagatgcaccgggatgagctggagacccgagtctctgctttcgcgcagagcccggcctacgagcgcatcgtctccagcggctacctgtcggccctgcgctactatgacacctatctgtatgtggggcgcagcgggaagcaggagagtgtgcagcacttttacatgcggttagccggcttctgtgcctcaaccacctgcctctacgcgggtctcagggcagccctgcagcgggccaggccggagattgagagtgacatggaggtgtttgattactactttgagcacctaacctcccagacggtgtgctgctccacgccctttatgcgctttgccggggtggaaaactccactctggccagctgcatcctcaccacccccgacctcagctccgagtgggacgtgacccaggccctctataggcacctggggcgctacctctttcagcgagccggggtgggtgtaggggtgacgggggctggccaggatgggaaacacatcagcctcctgatgaggatgatcaacagccacgtggagtaccacaactatggctgcaagaggccggtcagtgtggcggcctacatggagccctggcacagccagattttcaagtttttggaaacgaagctgccggagaaccacgagaggtgcccgggcatctttacggggctctttgtccccgagctcttcttcaagctttttagggacacgccctggtcggactggtacctgtttgaccccaaggacgccggggacctggagaggctctacggggaggagtttgagcgcgagtactatcggctggtgacagcgggcaagttttgtgggcgggtctccatcaagtccctgatgttctctatcgtcaactgcgccgtcaaggccggcagccccttcatccttttgaaggaggcctgcaacgcccacttttggcgcgacctgcagggcgaggccatgaacgccgccaacctgtgcgccgaggtgctgcagccctcgaggaagtctgtggccacctgcaatctggccaacatctgcctcccgcgctgcctggtgaatgcgcctctggcggtgcgggcacagcgggccgacacgcagggggatgaactcctgctggccctccctcgactctcagtcaccctacctggagagggggcagtcggtgatggattctcgctagcccgcctcagagatgccacccagtgtgccacctttgtggtggcctgctccattcttcagggatcccccacttatgattccagggatatggcctccatgggcctcggggtgcagggcctggccgatgtctttgcggacctgggctggcagtacactgaccctccctctcgctcgttaaacaaggaaatattcgaacatatgtactttacggccctctgcaccagtagtctgattggacttcacaccaggaagatttttccgggtttcaaacagagcaagtatgccggggggtggtttcactggcacgattgggcaggaacagacctttctattcccagggaaatttggtctcgcctctctgaacgcattgtgagggatgggcttttcaattcacagtttatcgccctgatgcccacctcaggctgtgcccaggtgacgggctgttcggacgccttctaccccttctatgccaatgcgtccaccaaggtcaccaacaaggaggaggcccttaggccaaaccggtctttttggcgtcatgtgcgtctggatgacagggaagctttgaatcttgtcgggggccgtgtctcctgcctcccggaggctctgcggcagcgctacctgcgtttccaaacggcctttgattacaaccaggaggacctgattcagatgtcccgggacagggccccctttgtggaccagagccaatctcacagcctgtttttgcgtgaggaagatgccgcgcgggccagcacgctagccaacctactggtgcgcagctacgagctgggcctgaagactatcatgtactattgtcgcattgagaaggccgccgatctgggggtgatggagtgtaaggccagcgcggctctgtcggtgccgcgggaggaacagaatgagcggagtcccgctgagcagatgccgcctcgtcccatggaaccggcgcaggttgcggggccggttgacatcatgagcaagggcccaggggagggaccaggtgggtggtgtgtgcccgggggattggaagtgtgctataagtaccgtcagctcttctcagaggatgatctgttggagactgacggttttactgaacgagcctgtgaatcttgccaataaacgtttattgccatgtccaagttgttgtacgtgcgtgatcatgagggctttgcctgcctaacggtcgaaacccaccgcaaccgctggttcgcggctcacattgtcctcaccaaggactgcgggtgtctcaagctactcaatgagagggacttggagttttacaagttcctctttacgttcctggccatggccgagaagcttgtgaactttaacattgatgaactggtcaccagcttcgagagccacgacattgatcactactacaccgagcagaaggccatggagaacgtccacggggagacttatgctaacattttaaacatgctctttgatggggacagggcggcgatgaacgcctacgcagaggccatcatggccgacgaggccctgcaagccaagatttcctggctccgtgacaaggtggcggccgccgtcaccctgccggagaagattcttgtgttcctgctgattgaaggcatcttcttcattagctccttctacagcatagccctgctgcgggtccggggcctaatgcctggcatctgcctggccaataactacataagtagggatgagctgctccacacccgcgctgcctccctgttatacaatagcatgacagccaaggctgaccgaccaagggccacctggatccaggagctgtttcgcactgcggtggaggtagagactgccttcatcgaggctcgtggagagggggttaccttggtggatgtgcgagccataaagcagtttctggaggccacggccgatcgcatcctgggtgacattggtcaggctcccttgtatggcacaccaccccccaaggactgcccgctcacctacatgactagcatcaagcaaactaatttctttgagcaagagagttccgattacaccatgctggtggtagatgacctttgagtcagggtggctacttgctcaggtttctgggcataaattctcctgcctgcctctgctctggtacgttggcttctgctgctgcttgtgatcatggaaaccactcagactctccgctttaagaccaaggccctagccgtcctgtccaagtgctatgaccatgcccagactcatctcaagggaggagtgctgcaggtaaaccttctgtctgtaaactatggaggcccccggctggccgccgtggccaacgcaggcacggccgggctaatcagcttcgaggtctcccctgacgctgtggccgagtggcagaatcaccagagcccagaggaggccccggccgccgtgtcatttagaaaccttgcctacgggcgcacctgtgtcctgggcaaggagctgtttggctcggctgtggagcaggcttccctgcaattttacaagcggccacaagggggttcccggcctgaatttgttaagctcactatggaatatgatgataaggtgtccaagagccaccacacctgcgccctgatgccctatatgcccccggccagcgacaggctgaggaacgagcagatgattgggcaggtgctgttgatgcccaagacggcttcctcgttgcagaagtgggcacgccagcaaggctcaggcggcgttaaggtgacactcaatccggatctctacgtcaccacgtatacttctggggaggcctgcctcaccctagactacaagcctctgagtgtggggccatacgaggccttcactggccctgtggccaaggctcaggacgtgggggccgttgaggcccacgttgtctgctcggtagcagcggactcgctggcggcggcgcttagcctctgccgcattccggccgttagcgtgccaatcttgaggttttacaggtctggcatcatagctgtggtggccggcctgctgacgtcagcgggggacctgccgttggatcttagtgttattttatttaaccacgcctccgaagaggcggccgccagtacggcctctgagccagaagataaaagtccccgggtgcaaccactgggcacaggactccaacaacgccccagacatacggtcagtccatctccttcacctccgccacctcctaggacccctacttgggagagtccggcaaggccagagacaccctcgcctgccattcccagccactccagcaacaccgcactggagaggcctctggctgttcagctcgcgaggaaaaggacatcgtcggaggccaggcagaagcagaagcaccccaagaaagtgaagcaggcctttaaccccctcatttaacaccatgttctcgtgcaagcagcacctgtccctgggggcctgtgtcttctgtctcggcctcctggccagcacccccttcatttggtgctttgtctttgccaacctgctctctctggagatcttctcaccgtggcagacacacgtgtacaggcttggattcccgacggcatgcctaatggccgtcctctggacgctggtacccgccaagcacgcggtgagggccgtcactccagccatcatgctgaatattgccagcgccttgatcttcttctccctcagagtctactcgaccagcacgtgggtttctgccccctgtctctttctggccaacctgcctctcttatgcctgtggccccggctggccatcgagattgtttacatctgcccggctatacaccaaaggttctttgaacttgggttgctcttggcctgcaccatctttgccctgtccgtggtctccagggccctggaggtgtcggctgtcttcatgtctccatttttcatctttctggctttgggctctggaagcctggccggtgctcggcgtaaccagatttacacctcgggtctcgagcggagacgcagcattttctgcgcccggggagatcattcggtggcatccctgaaggagaccctccataaatgcccgtgggatctgctggccatctctgccttgaccgttcttgtcgtctgtgtgatgattgtgttgcatgtgcacgcagaggtgttctttggactctctagatacctgcccctctttctctgtggggcgatggcctccggggggctgtacctgggccattccagcatcattgcatgtgtcatggccaccctctgcaccctgacatctgttgtggtatatttcctccatgaaacccttggacccctgggcaagaccgtgctgtttatctcaatctttgtctattactttagcggggtagcggccctgagcgcagctatgcgctacaagcttaagaagtttgtgaacggacccctggtccatctccgtgtggtatacatgtgctgttttgtctttactttttgtgaatatctgttggtgacattcattaaatcctaacgaccggagtcctgtctctttgtgttcttgggggacttgagttagctgtctttcctcttattacattgggctaacgggaggaaatgaacccaggggtggcagtggatggggtcatttatgggcaaaactcacaggacatgtttggggagttagcattggcgtcgggaaacacagctctggcagttataaccgcaccagctaacaggacatgtttgggggagttggcattggcgtcaggagacacggctctgtcagttatcaccgtaccatgagtgccatgtgtgtccagtgcctaatcaccgttcctcattttgtgtgcctcctcaaatgttccagaagtcggccacaggggaggtggctgaattagggccttttccctcattcccccatgagacccacgtggcaggcctaggggctacattcgcctcccacgtttcccttcgcgtgaggcatccgatatgactgaattttcgcagtctcttttccctcttcccttgttattcccatagaattacagtgaggttacacaggtggagattcagtttaaccatttattgatttaatccaggaacaaaaaacagtcctagtgacccagtgcccggagagagaatggccctgacaagtcggctgcatgatgcacttcggcagtcacgtgtgtgagtctccacggcctctgtcaaaagggagcttagcgtgccagggttgtaattcttgatgtagtggcccaggaattcaacttcatcgtgtctccgtctgcagttggcgttaatgtaggctggggctactgccgcatatgctgccaagagacagaggggctgcttcacatatgagctgctcagggtctccaccaccttgttttgacgggccgtggcacaggtgatgtagaagagttgcttcacaaagttgtagtctcgcgtgttaggaaggaagcagggtgccagctctttgagcttggtcaggatcaccttgctaagactcatggcgcaggccaggaggatgtcttccgcgggagctaggggcaggtcgccgtggtaggtgatctcctggagccaaaagatggtctcttctagcatggccaccagggtgcagagccccgcgttctggatcgcctgcatgcgtgcatccagccatgtgtccttgttggttgacttggtgaaaaactcacgtagtgtcttgtagctcctgcgcagctcgtgtctgggttgcactttctgccaggctccaatctctggatgggcggccaccgccagcatcgactgtaggaacgggtcttggatgggctctagggtcagagaggccagggggctgggcaaggtgacaaatgtaatcttggagacaggcttaaccagactcatgtcaaaccacggtttgttcggcaggggcctctggctgcgttcttgcctcgcctgcttccttgtgctcctgccggcccctcgagattctgaccggggacctctggttgctctgttgcttcggggagctcttggagacctcggtgctctaggcaccctgggggcccttggggctctgggcgctcttgctcccgggggcaggtgtcggcgcttgccataactttcatcggtgcagccatggacctctccgcgtcgccttttgtggcctctggtgtaagaggagttgccagtctcctccttctcgtcctcgtccctgcacaggggtgagcgatgcaatgtgactgtcttgtcctgtaggtcccacttctttctgggaatcacaaacgatgccgaggtaggggttatgaccacgctggagggccgtgcaggtatggcgtgggccggagttggatcttcatcctcctcctctgaggatgaaatctctccatctgtggagtgttcttcgctgccctccatagggtccagatcgcagtctgtgttggtgtctgagaccgcttcgagttccagaatgtggctctctgcagaggggagacaaaaggtggagactgccttgagcacctctgtctcaggcaccggatgcccccggctccacggccccggccactggccggtgtagcttcttacctgcgggatcctcgttggaggaaatgctgctagttcgggagagtctctgagaaggaaccatcttgtctgtctctacgacgggctagctgggatgtagtgctgtcttgactggcctcagccctatttatgattctggaggcgggcacgctgatggagaaatgggcggtcggttgattggccccacagcgaccggcgaagcactgactcatgaaggtgaccgtgatggcctgtgatgtgtagtagagtaccagaaacaccctcacattcttggagctggccctgtgggtatgcctcaggcacgcaaagttcctgccccgggcatggcacacctgaactaagtttggcccggtttgctcaaacgtgacatggagaaactgggggaatttgtcttctggcacagctgttgccagggtgctcatgagcgagggccagatgcaggagctgacccaggcgacgagatccaggcccagatgtccctctatcatggcgcagacattctccacggtggggggcagggtctcgcgggtcctctggattagatagtcacgcccatcatccgcgatgtggtagcagaaggttttgggggccggccagcccacgtgcagtgagtgatgtaagaggttttgaatgttgagggcattcttaacatagctgtgcttgtcttcctcttccggatgacagacaaagaggcgcagctgccggctaagaccaccgcccctgtccaccttgtaggtatgcggcagccggatgcaccgcccggcgtgatacacgccgctgtcaaaaagcggggccccaatctctttgatcttgtgacgcatgcggcgcaggcaggccgttaggcccatgagcttctgcagcacagacacaaacccttgtactgcgcttgttcccacaatagcatggcctctaggtaggggggtgatgacgcgaaagcccagttttcccgtgcatatgcaaaaggggagcacatcttccatattatccgggtcggcgggtggacaagctgatttgaaaaaatagactgggtgggccctggacactggacccaggcggcgcatgaggcgcagtacctcacgccgcacggtccggcacaggtcatagatttcctccagcgaccagggggcccccttgatctttagatccaggtccaagaccaggttgcagaccggaagccggggattaaagtattcatgccgggagacaaagagctgctcgctcaggctgttctgtgaatagtacactggggtgtaggagagggccctggtgagacacgtgtctgggaggcggcagttggtcggggtggagacgacctccgccaggtgggatgagaaggggtcagcggctgtcattacaaagtagtgcctgtctgcaaaatggcagaggaagaccggtagccgctgcacccttcgaaggacggtgggtgggaggaattgttccttgggattccactggccccggcaggtggcctggccggccaagcatagaaacccttgaagcgtgggggggtatgtgggaccctcatccgcgtgccagcgcgcgagctccaccagctcccgggccacgtccacactgagcccggcccaggcccgcatgagtccgtcatcggggtcggggtcccacgtgtatggggccgggggctccatgcggattttcagctgctggacacgcacatgctcagccaggtaagtctcccgggtgaagtaggtgcgcatgtgctccgcaaagcccctgtccaggagcgaggggagcacgacgccccccgaaggcagacacccaatttctcccatgctcgttaactgagagtatcgcttaaaggttccctcgttgaagcactgtgcgtgggccaaatagacgtagcgcacgagatcggccgaggccaggggaaggcgccccctgtaggcgtctatcgtccttgccacagcgcggatctctcgcgagtcccgccgcagtttctcgtgtgcaaagtgggcaaaagcctcggtctgctccgcccatgccgaggagccaaagacctcccccagctcggccagggacgtgacggcggccaggctctgaccagactcggaagtaaatagctccgtgaggtgcgccagggtctcaatcgtacaaggaatgccccaaaaatagtaagcagccgtgactagcacgaactgggcctcgtgggagccaaaggtgctaatgaaccacctggccgagatgttaacgcggtagatgcggcgcagacagcccacgatcttgggacgcagccacgccacgcggcctctggcatccccctgtggctgtttcttagcgctcagtgtgagcagttccacgaggggcgtgagcgagcgcagggcccccgcgcgatctaggtaggtggatagacggtccgcggtgagcggcgtgaggccgcgcaggaaggggaaggcctcctccgccggcaggtgcagcgtcagaaccaggccgcagcggctctgtgaggtcagccgcttcttgggcaggtgaagctgcagttccacgagagaacccgccacgtggtggaggggcgaggcgttgtggcacaaacaaaacaggcggaagccctcgtcaggccgcgagaggatggcatcgaggatggcctccgcaatgtcagtgtttgaggccacaagggccttgatgacgacgggggcggacattatttaagaccgggaggccccaacggcgggctaaacagaacgatggccttctatctcccagactggtcgtgctgcgggctctggctctttggccggcccaggaatagatacagccagctccctgaggagccggagacctttgagtgcccggaccgctggcgagccgagatagatctgggcctgccccctggtgtgcaggtgggagatttgctaagaaatgagcagacgatgggctcactgagacaggtttatttgctcgctgttcaagccaatagcatcacggatcacctgaagcgctttgacgccgtccgcgtccctgagagctgtcgtggggtggtggaggcccaggtggccaagcttgaggccgtgcgctcagtcatctggaataccatgatctctctggctgtaagcggcatcgagatggacgagaatgggctcaaggccctgctggacaaacaggctggcgacagcctggccctgatggagatggagaaggtggccacggcgctcaagatggacgagaccggtgcctgggcgcaagagatctcggccgttgtctcatcggtgaccgccccctcagcctcggcccctttcatcaactccgcctttgagcccgaggtgcccacccccgtccttgcaccgcctcccgtggtgcggcagccggagcactctgggcccacggagctcgcgttaacgtagcaaccagactccacaccaaataaacattttattggtaaaacaagggatatgaaggtgtcattgacccgaggatccaaaccccctcccctgtctcccctcgagcgcctcgctcagcccactatcacccatggccaggctcggcacctcctcgaaggtgcagctggcccacctaaagagagatctggggccaaggacccccgcgtcactgtgggggctgtagaaggaggtgaggtggtgcttgtgaaggtaaacaagctgacagaagcgccggtacttgttaaggaacacggtctggtcactaaagttggtcaggctgacgtccaccccaccccggcgccacctgcagggcttcactagaataccctgcatggccaggcccgacctgccaaagattgtcggcctgtggtgagggatagaaggggggggcacggtgagtgtcactgagacggtctgatgggggaagagggccaggtcctttggcaaagagacgtccaggcccacgtccccggggtactgggggtggttgatgggacccttgtcctcctccatctggggggtggcatatctgaaggcagccaggtggattttgagctccgatggacgcagcgtggagttgtagcgccgctgattctggaggattagccggagttcccccgtgtagccgggatcgatgatgccaacatgagacgtgaccggacgggaggtgctgccccacagcatgagcccatgaccctcgggtgggcgggcatagaggcctaggtccacagttgtggtcttcatcgggcgcagcaggatggtggtcttgttgaccaaggtgagccgccctacactagcctgctggagcaacagcttgtcattctggaaggcgtagcgtatgtgtggacaggcctccatggtgatgatctaacagacagggacggcggcgctatatataagagcccaagacccggctctctttactgcgaaatggggaaggtcctaagaaagccgtttgcaaaggctgtgccactgctcttcctcgccgccacctggcttctgaccggggtgctgccggccggcgcttccagtcccacaaacgcggcggcggcttccctgactgaagcccaggaccagttctactcctacacatgtaatgcggacacattctcgccttctttgaccagctttgcctccatctgggcacttctgacgcttgtcttagtcattatagcctcagccatctacctgatgtacgtctgctttaacaagtttgtgaacacgctgctgacggattagatggggatatttaaaaggggcagcaatctcggctgtttgtacttcttctctgctcgttaaaccaatagcatgtcagctccacgcaaagtcagattgccttctgttaaggctgttgacatgagcatggaagacatggccgcccgcctggctcgcctggagtctgagaataaggctctgaagcaacaggtcctcagagggggtgcctgtgcctcgtctacctctgttccttctgctccagtgcctccgcctgagccgcttacagctcgacagcgagaggtaatgattacgcaggccacgggccgtttggcgtctcaggctatgaagaagattgaagacaaggttcggaaatctgttgacggtgtaactacccgcaatgaaatggaaaatatattgcaaaatctgaccctccgcattcaagtatctatgttgggtgcaaaaggccaacccagccctggtgagggaacacgaccacgagaatcaaacgaccccaacgccacccgacgtgcccgctcccgctcccggggacgtgaagcaaagaaagtgcaaatttctgattaataaatttttattgactttatacataggtctcggcgtcatcatatggtggggtggtgtaggtatgggatgtagacaagttacgcctaaaggcgcagtccgccatgaccagcagcagcagaagggtcagcacagccagagaggcccactgcagtactagcatggagaggtttgagaatctgggctgggacgttggcgggactggcacggtggcttgggctgtggtaaccggtgggctcgtaaaagtccagcggggccgcagtttgctagaagtgctgggaggtagataggtggtcgcattgtatctcggtcttggcgtagttgaatcaccgccgtaatctgtggtgggctctgtacttgtccgggctccatgtcctgtggtgtgctttccaccggtggtagaattggcctttccacctgttgaggtgaccgtgggaaccgccgtcttttggccactgggggcctggggcgacgttgcattttgggggggcgtgcctttggtgacattaacctcccccggttttgtggatgtggaactgtttccagggcctgacgcttggctggtggtgcctgggcggggtgctggcgaactggtggacacatgatgtgtgctgatagaggctggtgtcacctgtgttatattttcaccacctgttgggtgagcggaggttagtaaaggcatatgtgacgttgaattgtcactggtggaggggctgagtgtctctgggtttgaactgggtctcagtgacatggaagaggttgaacttgaagttatgttatgttggcctgtggtaacagcactggttgcattttttggttggctggtaactactggggtgggacttgttcctcctaaggtgtggttggtggcatttgcctgtggacttgtttctcccacagtagggccggtggcatttggggttggggtagtcactgctgaggtggggcttgtttttcccaaggtggggctggtggcatttggggttggggtagtcactgctgaggtggggcttgtttttcccaaggtggggctggtggcatttggggttggggtagtcactgctgaggtaggacttgtttttcccaaggtggggctggtggcatttggggttggggtagtcactgctggggtggggctggtggcatttggggttggggtagtcactgctggggtggggctggtggcatttggggttggggtagtcactggtgaggtggagctggtcatgtcgggggccttactttctgtgccgttgtcccatggagatggacttggtgtcaccggtgatgcgcctgacgttgtgccggctggtgttgggctggtgacatccgcggtggatacagtggggcctgtgcttgcaggtgcggtgaggttggtaggcacgtgagtagagctgggtagacctgtcgttgtattgggatcagcaaatccagttgtattcaaggtaggggaggtggtggtgctctcgggtgccttggagaatataaccttgtgggttgttgtggtggcattggtagccgttcgtgtgataatgagtgtcttgggggccgtgccaagacccgagacagtaatgtcaaatgtccgattgctcgcaaatgcaccagaaatattttcacaacccgaaggtgtccccgaggtgagagtccatttgcacttaaagtcagtttcagtgttgtttggccaggcccaaaaggcagtcactgtaacatttggcgagtttgcgtcctcagaagtgaccattggcactgaataggtagcattgtcacccacatatgtgatgtctgtggtgtttgtcggcatgtcctgtgaagctggaatctcatcagagaacacaatgttggactgaatgcagtaatctcccccgctcgccttcggtccattcccagagtaaaacacgtacaggatactgttattgccaagaaatcgtgacactggacgtggtgtcagacgcaggctgtatgcataccctgtaccaggtattggggtggccacgggactcgttgatgtgagaattccgccgctgggaacatggctctcgtatccactgcaggtgatgttaaatttgttgtctccgggcagaacttgtgaaatttcgccatcctccataatacactcaatatctatctcattaccgagcatttctgtttttacgctgaaattcgagtcttgagctgacgttggcaaacttaagggtagcgtgacatccagcccctgtgccctcactactgccgttatattggtagaattacagttatcccactttatgtatggcactgtttctggtatcaggtacacggggttttgcatttctgcatggtggcaccacatggttccaaacacatcttgaaagtagacatctacagattccaggcttacttgttgctcctctccggtggtgacgttaattggaagcttcttagaccgcatagttagagccaattctcctgcaccaaggagctccagtagaaagagattggtggcattttctgagccaccaaatgcacctcgaggttggtagacagccttcgtatggggtgtcagctggccaaagtcaagatcaagttgatgctttttgcccccgacatcgaaattgatagttacattgacatctgccgtgcaaacattgcatgtggggtaaaatgggaattccggaatctcaacattgaaaaaaccaggatcttcacccgtgagatggatcaggctctggatggtgtactgacacacaagcaaggctgcctccattgtctcggcaccgatttctaggcagcatcctctttaataggtacaaggggggtgcggtgttggtgagtcacacttttgttgcagacaaaatggacaaggacaggccgggtcccccggccctggatgacaacatggaagaagaagtcccatctacctcggttgtgcaggaacaggtatcggcgggagattgggaaaatgtcctcatagagttatcagatagcagctcagaaaaggaagcagaagatgcccacctggagccggcccagaagggtacgaagagaaagcgggtcgatcatgatgccggtgggtcagctccagcacgacccatgctcccaccccagccggatctccctgggcgagaagccattctccgcaggtttccactagatctaagaacacttcttcaagcgattggagccgcggctacggtgagcatccctatggcctaagtgtgtgatgtgtgtttttacccatcacacaacaacaaggtaagtaatttgttgccgttggtttcagcgcatcgacacacgagccatagaccagtttttcggatcccagatttcaaataccgagatgtacataatgtatgccatggccattcgacaggccattagagatcgtcggagaaatccagcttctcgtagagatcaggccaaatggagactgcaaaccctggccgccggatggcctatgggttaccaggcatacagcagctggatgtacagctacaccgatcaccagacgactcccacattcgtacatctccaggcgacacttgggtgcacaggtggccgtaggtgtcacgtgaccttttccgccggcacctttaagctgccgcgatgtacccccggggatcgccagtggttgtatgttcagagctccgtgggtaacattgtacagagctgtaatccccgctacagtattttctttgactatatggctatacacaggagcctcacgaaaatctgggaggaagttttaacacctgaccagcgtgtttcatttatggaattcctaggatttttgcagagaacggatttgtcctatatcaagagctttgtcagcgatgccctgggcaccactagtatccaaacaccgtggatcgatgacaatcctagcacggagacggcacaggcttggaatgccggctttctccggggtcgtgcgtatgggatagacttgcttagaactgaaggggaacatgtcgaaggtgctaccggtgaaacgcgagaagaaagtgaggacacggagagcgatggagatgatgaagatcttccttgtatagtgtccagaggtggacctaaggtcaaacgaccccctatatttataagacgtctgcacaggttgctgctgatgagagcgggcaaacgaacagaacagggcaaggaggtactggaaaaggcccgtgggagcacttatggcacacctaggccgcctgttccgaaaccaagaccagaggtcccacaaagcgacgagacagctaccagtcacgggtcggcgcaagtcccagaacccccaaccattcacctagcagctcagggaatggcatacccattacatgaacaacacggcatggccccgtgtccggtagcacaggccccacctacgcccttgccccctgtatctccaggggatcaactcccaggtgtttttagcgacgggcgagtggcgtgtgcaccagtacccgccccggctgggcctattgtccggccctgggagccatccctgacacaggctgcggggcaggcctttgcacccgttagaccacaacacatgccagtagaacccgtccctgtcccgacagtggcacttgagcgaccagtttaccccaagccagttcgtccggcacctcctaagattgctatgcagggccccggggaaacttctggcattagacgcgcgcgggagcgttggaggcccgcaccttggacgccaaatccaccccgttctcccagtcagatgtccgtgcgtgaccgtctggctcgtttgcgtgctgaggcacaggtcaaacaggctagtgttgaggtgcagcccccccagttgacccaagtatcccctcagcaaccaatggaggggccgttggtaccagagcagcagatgttccctggtgccccctttagccaggttgctgatgtggtccgggcacctggggtaccggcgatgcagccacagtactttgacctccccttaattcaacccattagccagggggcacccgtggccccgttgagggctagtatgggcccggtacctccggtaccggcaacacagccacagtattttgacatccccttaactgaacccattaaccagggggcatccgcggcccattttctccctcagcaaccgatggaggggccgttggtacctgagcagtggatgttcccaggtgccgccctgagccagagtgttaggccaggggtagcgcagtcacaatattttgacctccccttaactcaacccattaaccatggggcacccgcagcccatttcctccatcagccaccaatggaggggccgtgggtacccgagcagtggatgttccaaggtgccccccctagccaaggcactgacgtggtccaacatcagctggatgctttggggtatacactccatggtcttaaccatcccggggttcccgtgtctcctgccgttaaccaatatcatctcagccaggctgcctttgggttacctattgatgaggatgagagtggcgaggggtccgatacctccgagccgtgtgaagctcttgatttgtcaatccatggcaggccctgccctcaggcccccgagtggcctgttcaagaggagggtggccaggatgccaccgaggttcttgatttgtcaatccatggcaggccccgccctcggacccccgagtggcctgttcaaggggaaggtggccaaaatgtcacaggccctgaaactagaagggtggtggtgtcagctgttgttcacatgtgtcaggatgacgagtttccggatctacaagatcctccagatgaggcctaagcaaaggtgtagaagtgtgtccccctccattccacccactgataatacgcccgacaataaagttgatgatattgaattccacacctgcttgtgtttgtgattttatttcatattccatgagagagacctcgcatatttgcagaagggtcactgaaacatcttatcttaaaacagttacacctgaataatgaagaaagcgtggctcagcagagcacagcaagccgatgccgggggggcatctggctccgaggacccaccagattatggagatcaaggtaatgtgacacaggtgggatctgagcctatttcacctgagattggcccctttgaactctctgcggccagtgaggatgatcctcaatctgggccagtggaagagaatttagatgccgctgcaagagaggaagaggaacctcatgagcaggagcacaatggtggtgacgatcccttggatgtccatactcgccagcctagatttgtggatgtgaacccaacgcaggctccagtgatccaactagtccacgctgtctatgattccatgttggtaagaggcacctagaacatttccagatgtttcgcttggattttttggccagtcttaattgattgtcattggtttcagcaatcggacctccggcccctaggcagtttattccttgagcaaaacctgaacatcgaagaatttatatggatgtgcatgaccgtgcgtcacagatgtcaggccatcagaaaaaaaccattaccaattgttaagcagaggcgttggaagctcctgtcatcttgcagatcctggcgtatgggttaccgcacgcataacctcaaagtaaacagttttgagtcagggggggacaatgtccacccggtccttgtgactgctacgctaggatgtgatgagggcacgcggcatgcaacaacgtacagtgctggcattgtacagataccacgaatatcagaccaaaaccaaaagatcgaaacagccttcctgatggcacgtcgtgctaggtcactttcggcagaaagatatactttgttctttgatttagtatcctccggaaacaccctgtatgctatatggattgggctgggcacgaaaaaccgagtttcatttattgagtttgtaggatggttatgcaagaaggaccacactcatatacgcgaatggttccgccagtgcaccgggagacccaaagcagccaagccatggttaagagcgcatcctgtcgccattccttatgatgatccgttaacaaacgaggagattgatctggcctatgcccgcgggcaggccatgaatattgaggctcctagactgccagatgatcctataattgttgaggatgacgacgaaagtgaggaaattgaagctgaaagcgacgaggaggaagacaagagtggaatggaatctcttaaaaatataccgcaaacactgccgtacaatccaacagtatacggcaggcccgcggtgtttgaccgaaagtcagatgcaaaatcaaccaaaaaatgcagggccatagtaactgactttagtgtaatcaaggccattgaagaggaacacagaaagaagaaggcagccagaacagagcagccaagagccacgcctgaatcccaggcccccacagtggtcctccagcgaccacccacgcagcaagagcctggccccgtcggcccactgagtgtccaggctcggctggagccatggcaacctttgcctgggccccaagtgacagcagttctacttcacgaagaatccatgcagggtgtccaagtacatggttcgatgctagaccttcttgaaaaagacgatgaagtcatggagcagagggttatggcaaccctactgccaccagtaccacaacagccccgggctggcagaagaggcccttgtgtcttcaccggtgacctaggcatagagagtgatgagcccgcttcgacagagccggttcatgatcagctactgcctgccccaggacctgaccctcttgaaatccaaccactaacgtcccccaccacgtctcaacttagcagttcggcaccaagctgcgcacaaactccatggccggtggttcagccaagtcagactccagatgacccaacgaaacagtcccggccaccggaaacagctgccccacgccagtggccaatgcccctgcgacctatccctatgcgccccttgcggatgcagccaatcccatttaatcatccagtgggacccactccccatcagacacctcaagtggaaataacaccatataagcccacttgggctcagatagggcacattccatatcagcctacaccaacgggtcctgctaccatgctgttgcgccagtgggcacccgccaccatgcagacaccaccgagagcgcccactcccatgtcaccacctgaggtgccacccgttccccggcagaggcctcggggggcgcccactcccacgccacctcctcaggtgccgcccgttccccggcagaggcctcggggggcgcccactcccacgccacctcctcaggtgctgcccactcccatgcagctggcactaagggctcctgctggtcagcaggggccgacaaagcaaattttgcgccaattgttaacggggggcgtcaagaaagggagaccatcacttaagttacaggccgcccttgagcgtcaagccgctgcgggctggcagccttcaccagggtccggcaccagtgacaagattgtgcaggcgcctattttctacccacccgttttgcagcccatacaggttatggggcaagggggttccccaacggccatggccgcctcagcggtgacacaggcacccacggaatataccagggaaaggaggggagtggggcctatgcctcccaccgatattccgccgtctaaacgagcgaagatcgaggcctatacagagcccgagatgccgcacgggggggcctcgcactctcccgtcgttatcttggagaatgtcggccaggggcaacagcagactctggagtgcggaggaactgctaaacaggaaagggacatgttggggctgggggacattgcagtttcttccccttcctcttctgaaacatcgaacgatgagtgatttcgcccatgtaacaagaactgggatgaaccctggggcaacagactgcggggaggaggggggcagtgataagtcatgacaattttagatgaggtagaaattttgcatattttcagacccaccatggaatcatttgaaggacagggggactctagacagtcacccgacaatgagcggggagataatgtacagactaccggcgagcatgatcaggaccctgggccggggcctccatccagtggggcttctgagagattggtaccagaagagtcatactcaagagatcagcaaccttgggggcaaagcaggggtgatgaaaacagaggctggatgcagcgcatcaggcgaaggcggagaagacgggctgccttgtccggccatcttttagacacggaagacaatgtgccgccatggttgcctccacacgacatcacaccatataccgcaaggaatatcagggatgctgcctgccgggctgtcaaggtgagtatgcctctaactgggttcatgggggccatctaaggcccacgtgtgacccatgtttccattaattttagcaatcgcacctgcaagcgctatcaaacctgatactcgatagtgggttagacacacaacacatcttgtgcttcgtgatggcagccaggcagcgtcttcaggacattcgacgtggacccttggttgcggagggcggtgtgggttggcgacattggcttctaacatctcccagccaatcctggcccatgggatatcgtacagcaacactacgcacattaactcccgtgcctaacagggttggggctgacagcatcatgttaactgccacatttggatgccaaaatgcggcacgaactctaaacaccttctctgccaccgtgtggacaccaccccatgctggaccaagagagcaagaaagatacgctcgggaagccgaggtacgcttccttcgtggtaaatggcagaggcggtaccgaagaatctatgatttgatagaactgtgtggctctctgcaccacatctggcaaaacttgctccagaccgaggagaaccttttagatttcgtgcgtttcatgggtgtcatgtccagctgcaataatccagctgtgaattactggtttcacaagacaatcggaaactttaagccatattacccgtggaatgcaccacctaatgaaaatccatatcacgcgcggagaggcataaaagaacacgtaatccagaacgcatttcgaaaggcacaaatacagggtttatcaatgttagcaacgggaggtgaacccagaggtgatgctactagtgaaacgagcagtgatgaggacaccggtagacagggttcggacgtggagctagagtcctcggacgatgagctgccatatatcgatcccaatatggagccggttcagcagaggcccgtcatgtttgtgagccgtgtgcctgcaaagaaaccgaggaaactgccttggcccacgcccaagacgcacccagtgaagcgcacaaatgttaagacctctgatagatctgataaggcagaagcacaaagcacccctgaaaggccgggcccttccgaacaatcatcagtgaccgtggagcccgcccacccgaccccggtggagatgccaatggtgattctccatcaaccacctccagtgcccaaaccggttccagtcaagcctacgccaccgccttcccgtaggagaaggggagcgtgtgttgtgtacgacgatgatgtcatagaggtgattgatgttgaaaccaccgaagattcatcgtcagtgtcacagccaaataagccacatcggaaacatcaagacggctttcaacgttcaggccgacgtcaaaaacgagccgcgcctcccaccgtgagtccttcggatactgggcctcctgccgtggggcctcctgccgcggggcctcctgccgcggggcctcctgccgcggggcctcctgccgcggggcctcctgccgcggggcctcctgccgcggggcctcgcatactggcgcctctttccgctgggcctcctgccgcggggcctcacatagtgacgcctccttccgcccggcctcgtataatggcgcctcccgtcgtacgtatgtttatgagggagcgacagctcccccagtccaccggccgtaaacctcagtgcttctgggaaatgcgggctggtcgtgaaattacacaaatgcaacaagaaccaagttcacacctgcagtccgccactcagcctacaacgcctcgcccatcatgggccccatcagtctgcgccctctcggtgatggatgctggtaaggcccagcccatagaaagttcacacttgagttccatgtcgcccacacagccgatatcgcacgaagaacaaccccggtatgaggatcctgacgctcctctggatttaagtttacatccagacgttgctgctcaaccagctccccaggctccataccagggataccaggagccgccggccccccaggctccataccagggataccaggagccgccgcccccccaggctccataccagggataccaggagccgccggcccacgggctccaatcatcttcatatccaggatatgcgggtccctggaccccaaggtctcaacatccatgttataggcacccctgggcaccatggtctcaagatcctgtgcatgggcacacccagggtccatgggatcccagggcaccacatctcccacctcagtgggatggatctgcaggacatggccaggatcaggtctcccagttcccacatctgcaatcggagacaggcccaccacgtcttcaactttcattggtgccactggtctcatcctctgcaccatcatggtcatctccccagccccgagcccccatacgccccattccaacaagattcccccctccccctatgccgttacaagatagcatggccgtggggtgtgactcatcaggtacagcatgcccaagcatgccctttgccagtgattacagtcaaggtgcatttaccccactggacattaatgccaccacgccaaaaaggcctcgagtagaagaaagttctcacggacctgcccggtgttcccaagctactgctgaagcacaggagattctcagtgacaattctgagatctccgtgttcccaaaggacgcgaagcagactgactacgatgcatccactgaaagtgagctagattaaggggatccaaggtgacccctgttagctatttgatctttgactgacacataaacatggtttaaggaatgaacactcatggtgtgagactggaactgtactaaatttgctgacatatgtacaatgagagccaaaaatttgataaaccttaaaagtccccccatctaatgatgtccagttcccttctcccaccctgtacaccccgacccaaagggactcaatggcattcagatttctagttaccacaggtagaatatcgggcgttggcccataaaaataagtgcatggatatagctctgcacaggcttggaaacacccattccaggtgtgcttctttttggtgaaataaaaacagcatcctttatatgaaaatgtgtattctctggtgttgcagtatgtacagttagctttggtatagttttggggtacctgaaatgtgtgcagggtgggtgtccaatgtggcagttttacctctttgtccccatactcctgctcggccgtcttgttaaagttaaccggcggtggaggatccaccggccagacctctacatttggtttgggtacccaggtgatggccgcggctgccacccgccctcctcctcttaccctgggtggcaaaaagtatgccaggagtagaacaataacaagtgcgatggcggtaaacaatggcaccctcacctgcttaaatgaaaccatggcaaccacttcaaagagagccgacaggaagatatttattaatattccattagtaaacgaggcgtgaagcaggcgtggtttcaataacgggagttagaaatttaagagatcctcgtgtaaaacatctggtgtccgggggataatggagtcaacatccaggcttgggcacatctgcttcaacaggaggcgcagcctgtcattttcagatgatttggcagcagccacctgcggacaaaaatcaggcgtttagatggggcatttatgtttgggacgctagccgcctgggcattcgtgttagtatatactgacctcacggtagtgctgcagcagttgcttaaacttggcccggcattttctggaagccacccgattcttgtatcgctttatttctagttcagaatcgcattcctccagctgcgagcaagggaatgcgttactacaagtggtgcctagtcagttgaaacaagccccaccatccgctgccgcccctccatgagccccaccgtccgctgccgcccctccttgagcccctccttaccgattctggctgttgtggtttccgtgtgcgtcgtgccggggcagccactggtgcaggctgtggaacaccaatgtctgctagctgttgtccttggttagccccggggcaagcaaacaccactgctgctgctgtttgaacagtagaattgtctccaggttgaggtgcttctcccccggcttggttagtctgttgattctgggttatgtcggagactgggaacagctgaggtgctgcataagcttgataagcattctcaggagcaggctgaggggcagaaaaccacgacccagtcggagcggttgaaacatgataggcagttagctggccttgtggcagaggctctggcagcaccggccacagcacacaaggcaaaggagcttgcgatggccctcccaggtcctgatagactctggtagcttggtcaaaagcttgtacaaaaggcacctggtatgggtcaggtgtaaattttacatcttcagaagtcgagtttgggtccatcatcttcagcaaagatagcaaaggtggccggcaaggtgcaatgtttagtgagttacctgtctaacatctcccctttaaagccaaggcaccagcctcctctgtgatgtcatggtttgggacgtgctaaatttaggtgtgtctatgaggtacattagcaatgcctgtggctcatgcatagtttctaaaagaggaggaggcagttttcagaagtgtctaaaataagctggtgtcaaaaatagacagcccagttgaaatatgcatggcatgcagcagacattcatcatttagaaatgtatccaagatttcattaagttcgggggtcaggggggagtccagattcaaatcctctgtcatggactctagtgttgtggtcagttcgtccaaatggccacgagggggcgggtggctcaggtccatctgtccacatatggctgcttcctccttctggggaataacagtgtcagccatctcccttagggccttcacggcctgactggtttcttcatcagggtcctccaacagatgacttgcctcgggggttactgcgggggccgggtcaagtggctggggcaccggggctggcgttagggatccgaccggttcatggacaggtcctgtgggggtgggagccaaagaggcaggcaggggccggttggcccacggggatccgggtggatggaagggcctgatcctctttggctgacacacctctcgcccctcgaacacgtcagatatggcactgcccgcttccggctttggcaggaacataccttcccggctatccctgaggcccttcttccttttaacgggaggaagaaaggtgggctttgaggggtgggggaatatgggtctctcatcgctctcttggtggaccgctgctatccaaggctgttcaggttccgccgcgttggaaggacatggagtttgaccacggttgggcctggatgtccggcgcgactttggggcccgcaggcgcggggcctcggccctggcctcttcccgctcgctctgctcggtgtcactgttgcccgagtcactgctgctggaactgctgtcaccgcagtcggcgctttgggcaccgggcttcaggggcatggtcgggctcgggagactttcgagttcatctgtaaaagcatgaaactgtccggactccgagtagcgggcctcggtgtgagaggcacccccatcattccccatgagctcctcgtccatcctgtcggctccggacacgaggataggagtttccactgccttggacttggttgacagcaggcacgcgggaagcacgccgctcacgtagctcctctgtccggcgtggctggagtaggaggcccggggcagtgtcttaatcagagccctgacatccttaacatcgtccgtcagatggcctgtcttggacgagaccatagtctggaacatctcctcgaggacgggataggtgaacacccacttgcaaaaggccttgaacttggagcttaggaggccttccttctccatcctgttcaggtgttccactacctgcttgccggaggccatgatggccgcgcggtccacgcccagcaccttgctgtaggtgtaggcccgcacccgactgtgttttaggagcttgtacatagcggtgcctatggtggcaggaatcatcacccggttgctgggggcctggatgaagaatctgtcagtgaccactatcaggtggtctaacacgtagcgcatcactatagggcacgcgatggaacatgcgtcgttgccggcattctcagcccgtcttcttaccctgttgtttcggagaatggcccaaaaattgcagatgttgagcgtggccattagcccgccccattctcgcccgtgggccttggcctcatttataaatgccttgcatattttgtaggatctcagagtaatctccacactcccggctgtaaattccttgttgaggacgttgcagtagtcagagaccagagagcccagctgctttttgatttcaggagttagcctcagaaagtcttccaagccatcctttttaggcctcatggctagtagtaacagaggaaatgcccgaccattaaaatctttcctccatgagctttacctgaaacactatcccgaagtgggggatgtggtgcatctactgaacaccatcggggtcgactgcgacctcccacctagccacccactcctgacagcccagagggggctgttcctggcaagagtcttgcaggctgtacagcagcacaagctgctggaagacaccatcgtccccaagatcttaaagaagctggcttatttcttagagctgctaagctactactcccccaaggatgaacagcgtgacatcgccgaggttcttgaccacctcaagacgaatcgggacctggggctggacgacagactctgggccctgattaggaaactgcgccaagacagacaccatgcctctgtaaatgtcctcatgccaggaagcgactacacagccgtgtcgctgcagtactacgacggcatctccataggtatgaggaaggtaatcgcggatgtctgccgcagtggctatgcctccatgccctccatgacggccacgcacaacctctcccaccagctcttgatggcgtccgggcccagtgaggaaccgtgcgcctggcgcgggttctttaaccaggtcctcctctggactgtggccctctgcaagtttcgcagatgcatttactataactacattcagggatctatagccaccatctcccagcttctgcacctcgagatcaaggccctctgcagctggataatatcccaggatggcatgcgcctctttcaacacagcaggcctctcctcaccctctgggagagcgtggccgcaaatcaggaggtcacggatgccattaccctgcctgactgcgctgaatacatagacctactaaagcacacaaaacatgtcttagaaaactgttctgccatgcaatacaaataaatttctcttacctgcgtctgtttgtgtagtgaggtgttgtgtcctgtatggtattctactttaaaaaggccggctgacatggattactggtcttttatgagccattggcatgggcgggacaatcgcaatataaaaccctgaccatcacatggggcattaggcgactctgcatcagcatcgcttaagtatgagtgggcagcagagaggctcggttattttggttcctgaacatctggctggggcattaactaagcttatgagcgattttatcacaggacaagatgtcactctttctggaggaaatattgcagtcaaaattcgcgatgctataaaccagacccccgggggtggtgatgtagctatactttcttccctgtttgctttatggaatgccctcccaacatctggtagacaatcctccagggacgatttaatcccagccgccgtgcaggccttaaccacggcccacaacttatgtctgggtgttattccaggtgagacctcacacaaggacacacccgagtcattgctccgggctatcgtgacgggtctccaaaaattgtgggtggattcgtgcggatgtccagagtgcctacaatgtcttaagggattgaaggcaattaagcccggcctttatgaaatccctaggataataccacacactaagcagtgtagtcctgtcaatctcctgaacatgttggtccacaagcttgtggctttacgtggtcatgtgcagcttgcatacgacgcccgtgtcctgacgcctgactttcacgaaatccctgacctcgatgactccgatgctgttttcgcacgcaccttattggcagccttatttcacctcaatatgttctttattctcaaagattacataacacaagactccatgagcttgaagcaggccctcagtggtcattggatgtctgccacgggcaaccccctgcctgcagcaccggaaaccctgcgagactacttggaagctttccgaaattcggataatcacttttatctcccgacgacagggcctttaaacaccttccaatttcccgaagagcttctggggcgcgttgttgttattgattcctctttgtgtgccgccagtcacgttcaggacgttatcacccatggtgttggggcgggtgttcctcgtcctcggttttcggccctgcctccggccccatcccgcgagccccagcagacatgctctcagttaacgagcagagggaatgaaagctcacggcgaaacttgggccagcccggggggacctcccctgctgttcccccagtttgccccatcgtttccctgacggcctcaggggccaagcaaaaccgcgggggcatgggatccttgcacttagccaagcctgaggaaacctcccccgccgtctccccagtatgccccatcgcttccccagcggcctccaggtccaagcagcactgcggggtcactggatcctcacaggccgcacccagcttttcttccgttgccccagtagcatctctgtctggtgaccttgaagaggaagaggaggggtcccgagaatccccatccctaccgtccagcaaaaagggggacgaggaatttgaggcctggcttgaggctcaggacgcaaatcttgaggatgttcagcgggagttttccgggctgcgagtaattggtgatgaggacgaggatggttcggaggatggggaattttcagacctggatctgtctgacagcgaccatgaaggggatgagggtgggggggctgttggagggggcaggagtctgcactccctgtattcactgagcgtcgtctaataaagatgtctattgatctcttttagtgtgaatcatgtctgacgaggggccaggtacaggacctggaaatggcctaggagagaagggagacacatctggaccagaaggctccggcggcagtggacctcaaagaagagggggtgataaccatggacgaggacggggaagaggacgaggacgaggaggcggaagaccaggagccccgggcggctcaggatcagggccaagacatagagatggtgtccggagaccccaaaaacgtccaagttgcattggctgcaaagggacccacggtggaacaggagcaggagcaggagcgggaggggcaggagcaggaggggcaggagcaggaggaggggcaggagcaggaggaggggcaggaggggcaggaggggcaggaggggcaggagcaggaggaggggcaggagcaggaggaggggcaggaggggcaggaggggcaggagcaggaggaggggcaggagcaggaggaggggcaggaggggcaggagcaggaggaggggcaggaggggcaggaggggcaggagcaggaggaggggcaggagcaggaggaggggcaggaggggcaggagcaggaggaggggcaggaggggcaggaggggcaggagcaggaggaggggcaggagcaggaggggcaggaggggcaggaggggcaggagcaggaggggcaggagcaggaggaggggcaggaggggcaggaggggcaggagcaggaggggcaggagcaggaggggcaggagcaggaggggcaggagcaggaggggcaggaggggcaggagcaggaggggcaggaggggcaggagcaggaggggcaggaggggcaggagcaggaggaggggcaggaggggcaggagcaggaggaggggcaggaggggcaggagcaggaggggcaggaggggcaggagcaggaggggcaggaggggcaggagcaggaggggcaggaggggcaggagcaggaggaggggcaggagcaggaggggcaggagcaggaggtggaggccggggtcgaggaggcagtggaggccggggtcgaggaggtagtggaggccggggtcgaggaggtagtggaggccgccggggtagaggacgtgaaagagccagggggggaagtcgtgaaagagccagggggagaggtcgtggacgtggagaaaagaggcccaggagtcccagtagtcagtcatcatcatccgggtctccaccgcgcaggccccctccaggtagaaggccatttttccaccctgtaggggaagccgattattttgaataccaccaagaaggtggcccagatggtgagcctgacgtgcccccgggagcgatagagcagggccccgcagatgacccaggagaaggcccaagcactggaccccggggtcagggtgatggaggcaggcgcaaaaaaggagggtggtttggaaagcatcgtggtcaaggaggttccaacccgaaatttgagaacattgcagaaggtttaagagctctcctggctaggagtcacgtagaaaggactaccgacgaaggaacttgggtcgccggtgtgttcgtatatggaggtagtaagacctccctttacaacctaaggcgaggaactgcccttgctattccacaatgtcgtcttacaccattgagtcgtctcccctttggaatggcccctggacccggcccacaacctggcccgctaagggagtccattgtctgttatttcatggtctttttacaaactcatatatttgctgaggttttgaaggatgcgattaaggaccttgttatgacaaagcccgctcctacctgcaatatcagggtgactgtgtgcagctttgacgatggagtagatttgcctccctggtttccacctatggtggaaggggctgccgcggagggtgatgacggagatgacggagatgaaggaggtgatggagatgagggtgaggaagggcaggagtgatgtaacttgttaggagacgccctcaatcgtattaaaagccgtgtattcccccgcactaaagaataaatccccagtagacatcatgcgtgctgttggtgtatttctggccatctgtcttgtcaccattttcgtcctcccaacatggggcaattgggcatacccatgttgtcacgtcactcagctccgcgctcaacaccttctcgcgttggaaaacattagcgacatttacctggtgagcaatcagacatgcgacggctttagcctggcctccttaaattcacctaagaatgggagcaaccagctggtcatcagccgctgcgcaaacggactcaacgtggtctccttctttatctccatcctgaagcgaagcagctccgccctcacgggccatctccgtgagttgttaaccaccctggagactctttacggttcattctcagtggaagacctgtttggtgccaacttaaacagatacgcatggcatcgcgggggctagacctctggctggatgagcacgtgtggaagaggaaacaggagattggtgtgaaaggagaaaatctgcttctccccgacttatggctagatttcctacaactcagccccatcttccagcgcaagcttgctgccgttattgcctgtgtccgacgcctgcggactcaggccaccgtctacccagaggaggacatgtgcatggcctgggcccgcttttgcgacccctctgatattaaggtggttattttgggccaggacccctatcacgggggtcaagcaaacggcctggcattcagcgtcgcatacggctttccagttccccccagcctgaggaacatctacgcggagctgcaccggagcctgccggagttttctcccccagatcacggctgtctagacgcgtgggcctcccagggggtgttgctactcaacaccatcctgaccgtgcaaaagggcaagcccggctcgcacgcagacattggctgggcgtggtttactgaccacgtaatttcattgctctctgagcggttaaaagcgtgcgtgtttatgctgtggggtgcgaaggcgggagacaaagcttcactaatcaactccaagaagcatctggttctgacctctcagcatccctctcccctggcccagaacagcacccgaaagagtgcccagcagaagttcctgggcaacaaccactttgtcctcgctaacaactttttgcgtgagaaggggctcggtgagatagattggaggctgtagaggggtcatcactatggccatgtttctgaagtcgcgtggggtccggtcttgcagggaccggcgcctcttgtcggacgaggaggaagagacttcacagagcagcagctacactctggggtctcaggcctcccagtctatccaggaggaggacgtgagtgacactgatgagtctgactactcagatgaagacgaggagattgatttggaggaagagtaccccagtgacgaagacccatctgagggcagtgatagcgacccctcgtggcatccttcagattcagacgagtctgactacagcgagagcgacgaggatgaagcaacccccggctctcaggcctcacgatcttcaagagtctcgccatctacccaacagtcttcaggtctgacacccacgccttcgttctcccgaccacgcacccgggcacctccgaggccgccggctcccgcgccggtcaggggacgggcctcagcacctcccaggccaccagccccagttcagcaatccaccaaagacaagggtccccatagacctacgcgacctgtacttagaggcccagctccacgccgcccccctccaccttcaagtcccaatacatacaataaacacatgatggaaaccaccccccccattaagggcaataacaactacaattggccatggctgtaaataaaatgtcataacctggagtctgcatgtctgttgttttattcagtaaaccagtagtgcgcgtgagttctttagggcatccacgatgtagccgctcgcggggttcccctccccagtgatcatctcggataggggattcctgtccatgaccacgcaattagagtgccgggcccgggacagcgccacatacacatggccgggtttgatgtttctgtggctgccgaagcagatggcgactttgtttagggacagaccctgggccttggctatggtcatggccagctttgagctaatgccatagtcacggatgctgcagaggttcagggacttgtcctctatcgtctcatacagtttgttagtattgtgttccaggcagcacacgaagcctgcctcatccttgaccattagcctgggcatgcgtgaactgccagcgtcctgaggctgctgctttcctcggatgccaaagaagacgttgagatgcgtgtagcccagaagcgtgtagttctcggtggtggaggcgtagtccaggaggccgtgaaggagaggctcgtctgaggtgaactctatgttgtcgcgaatcagcatgttgttggtaaatgtgcagaaggggaggtccctgaactcccttccgccatagcggacggccacatccaggcattgcctgaaataggccctgaggtcattatatatgtttaacagggagcagaggggggcagaatttgcggccgggggagccagtactcgggcatagaagacagcggcggggctccgctccccatcccaggcaacctccagcggcagttcgcccagctccatcccagcagtcacctccggatcccacgtacgcccgggcaggggcacagcaccaagctccgccacgtattccccgttttcacagagagaatgtcctccgtggctaaaagcgtagatgcctccgtagatgagtcgggccaggaagctgtagacatactcgggctgctcatgcccgtgggcctccacgaagctgtccgcctcgagcgtgtccataaagtccccgaaggtgccggtatagccacagatggactttttggtcttgcagttgaccgacaccgagctgtgcttgacgtaggtgacattgtaggtgaccttgacccgttcttcgtcctgctcggtgcccaccgggaccatgtcttggtcggcgaactgcgagtagttaccgaggcgtgcataattcttttggagccaggtgtgggccgtgaggcccggaagcccgaccagggtcttgtactgggccaggggatcgaggaagacctcgcactccaccgggcaggtaaacatggtcaccccgcccccatctcccccggttccccgcgcggcacgcccctgcccggcagtcttgagcgtggcatggagggtggtgaggaaggtcttgacctcggcgtgggagaggaagagccgggtccagcccacgtactgcgcggggtccattatggccgccctggggacgacgaagcggtcgacgtaggccaggatgtccggcgagagctcgaggccgtactcgagggtcttcatgaggtgtccaaactggacgtcggtgcagcgcttgttgttgatgaagagggcccagttgcgggccacgtccacgtaggtcgcggccctggggttgcccaccaggaaggtgaggatgttgtcgcactcgcgaatcttgtttacctgggtctcgtggctaaaggaggactgaaaggcgtctgtctgggtgggagagcccacgcagacgatgcagggaatgcggccccggcggtagagtggggtacgcagccaggcgttgaagaaccagtagcaaaagaccacggctgttagaatgtgcacggaaagcgttccagcttcgtccaccacgatcacattggtggtccatagctgcccctggtgcatgtctctcaggacctcaaaggcggggccagagactcccgagtagagccccctgggcttggttcgcctgaactcggcggcaatgtcggagagtaccggccagtatttggccaggtcccgccgctggagttcctctagggcggcgtccgtagagcgaccatgactgctgacccgctgcgtcatatttatgtggcggctcttgaacccaaaggcgctatagacggttgggcagtaggctcggagtgtctgggagaggttctgtgcggccacggttgtggctcccgtgaccaggcagtccatcgtgtggtggaggcagctaacgctggtgctcttgccagcccccgccgttcccgtaattacataggctgaaaagggcaggaaggggggctccgagagctccgggtcaaactcgggggagaacgtctccatatccgggagttgttggacgcggcgcctagccagggtccctatcctcctgactatacgcctcacggaggcgtctgaggtcatgttcaacatgaacgtggacgagagcgcctctggcgccctcggctcctcggccattcctgttcaccccacgccggcctcggtccgactttttgagatcctgcagggaaagtacgcctacgtccagggacagaccatctacgccaacctccgcaaccccggagtcttctcgaggcaggtgtttacccatttgtttaaacgagccatctctcattgcacgtacgatgacgtgctacatgactggaacaagttcgaggcctgcatccagaagcgatggccgagcgatgactcgtgtgcgagccggtttcgtgagtccaccttcgagtcgtggtccacgaccatgaagctgaccgtgcgtgacctgctgaccaccaacatctaccgagtgctacacagccgctccgtgctctcctatgagcgttatgtggactggatctgcgccaccggcatggtgcccgccgttaagaagcccataacccaagagctccactccaagataaagagcctgagggacaggtgcgtctgtcgggaattggggcacgagaggaccatcaggagtatcgggacggaattatatgaggcaacgaaggaaataatagagtcgctcaactccacgttcatcccccagtttacggaggtgaccatcgagtaccttccgaggagcgacgagtatgtggcctactactgtggccgccgcatcaggctgcatgtgctcttccccccggccatctttgccggaacggtgaccttcgacagcccggtgcagcgcctctaccagaacattttcatgtgctaccgcacgctggagcatgccaagatctgccagctcctgaacacggcccctctcaaggccatcgtgggccacggggggcgagacatgtacaaggacatcctggcccatctggagcagaactcacagcgcaaggaccccaagaaggagctgctgaacctgctggtcaagctctcggagaacaagaccatcagcggggtcacggacgtggtggaggagttcataacggatgcctccaacaacctggtggaccgcaaccgtctatttggccagcccggggagacagctgcacagggcctaaagaaaaaggtctccaacacggtggtcaagtgtctgactgatcagataaacgagcaatttgaccagattaatggcctagagaaggagagggagctctatctaaagaagatccgctccatggagtctcagctgcaggcctccctgggtcccggcggcaacaacccagcggcgtcagcccccgccgcagttgcggcagaagccgcgtctgtagatatactgacgggcagcaccgcctccgcaatcgaaaagctgttcaactccccgtccgccagcctgggtgccagggtgtctggtcacaatgaaagcatcctaaacagtttcgtttctcaatacatccccccttcgcgggaaatgactaaggatctgactgaactttgggaaagcgagctgtttaacaccttcaagttaacacccgtggttgataatcaggggcagcgtctctacgtcagatactcgtcagacacgatctctatattattgggccccttcacctatctggtggcagagctttcaccggtggaactcgtgacagatgtctacgccaccctaggcatcgtggagatcatcgacgagctctaccggagcagtcgcctggccatctacatcgaggacctcggtcgaaaatactgccccgcgagcgcgaccgggggagatcatggcatccggcaagcaccatcagcccggggggacacggagcctgaccatgcaaaaagtaagcctgcgcgtgaccccccgcctggtgctggaagttaaccgccataacgccatctgcgtggccaccaacgtccctgagttctacaatgccaggggggaccttaacatccgagacctccgggcccacgtcaaggcccggatgatctcgtcccagttttgcggctacgtcctcgtgagtctgctggactccgaggaccaggtcgaccacctcaacatattcccccacgtgttctccgagaggatgatcctgtacaaacccaacaatgtgaaccttatggagatgtgcgccctgctctcgatgattgagaatgccaagagcccctccataggcctctgccgggaggtgctgggtcgcctgaccctcttgcactccaagtgcaacaatctggactctctgtttctgtacaatggggccaggacgctgctgtccaccctggtcaagtaccacgacctggaggagggggctgccacccccgggccgtggaatgagggcctgagtctctttaagctgcacaaggagctgaagcgcgccccatccgaagcccgggacctcatgcagagcctctttctgacctcggggaagatggggtgcctggccaggtcacccaaggattactgcgcggatctaaacaaggaggaagatgccaactcgggcttcacatttaacctgttttatcaagattctttattgaccaagcatttccagtgccagaccgtcctccagaccttgagacgcaagtgcctcgggagtgacacggtctcaaaaataattccctagaataaactgagaacagtcatcagtaaatctgtctctcgcgtgatttccataggaatggtgtagccggggtggagggccgatatcacatcaagcagaaaggccataatctctcgaaagtaggcggtggggctgagaccatgctcagtggccgtctggcagggggccgggcgcgctccgtccttgtccaggagacacacgtggcttccagagaggcgcagcccagccctccgcagccgctgaagccaggctcgcggaagagcccaaaacctgtttcggcgccgcccgggggccagtctccgggtcaggtcgcggaccagggtcaacaggtggtcgtgggatggcggggccttgtctgcctcgggtctcgccgctagttggtccagggtccaggagaaggcttcgtgccaaaccaaaaagggccccgagtgctccctacatccacccacgtaaagatccccctgaaagatggccatcagtaggcacccgggcccgcgtcgagccttcacccgaatgtgtctgcgggccacggtggcctctccacccatcacatcccggtcgagccggctggcatcctccgagtctttcacgccttgcaggaaagcctaggagatacagcaacagaaagctattagccggtggttcccccaccatcattcttcctgttaacgggaagaataagagttgggcaaaccccgggggccgcgctctcccacccagccccgcttctcacctgtgctagtggctcctctgaaggatgggcggaggttggtgccacaaagcccaggatgaactcgtctgcataagcccaggtcagtcctaggtcagcggccgcgtgtaggagaacccgggtgacggcggtgtagaggcccccgagtgcccgtcgcgtgtctgaggtgccatagcggtgaagggcccgcagccaggtttgcgcgtcccgcgcctgccctccgccatcaggcgttcccacgggggcgcccctggcagagaggtggcagcgggccaattcgtagagccaccaagtggcatcagcctcaaggatggctgtggcctccgcgcgcccgaccaccgtcgtctcgtcctccccccctccctcgccgccttcccgcgtgcaaacgtggcgagggttaatctcctttcgggtcgggggccagatttgttgtaggagcagcgagccgcgtcgttgccctgaccgcgcgtcgaggcccaggagggcgtctgccaggggcgtcccagagactcccaggttcaggtccagtagcaggagaccctcgctgtgtggcgcccggtgccagaaggccggcctcgcccgtcccacataatggatgggcaggaagggaaagcccgggacatagggctggaaatctgagccccctgggcagagttcggggtccaggaggtagaagatgggcttggtgcctctgtggttggcgtagcaggaggcatagatactgcggaggaaggcgtagagcccgcccccggccatactccaagagttgacaagccaggactcgaatcccccagccggctcaagaattttcaggctgacgcggtgccgtcgggcgtccccaccacggccggtggccccgtcggacgacaccagatctacttcataagtgaccggtcgcaggatgtccctaaaggggacgggagaggggtcgtcgggagtctcggtggaataggtgaaaacatccccacgcggtgtcctgatgtatacgtccaactgtccgggagactcagagtgcctctgagcatgggggcatgtctgttccccctccatctcggacccgaagccatcaacaggtgggggttgttggtcccgcccatcatcccccgagcagctttggcagaccacctgtgctggaaagagaggctggaagatgaggccctgctcatcctccaccctggcggcggacaagagtctgcggtctcgggttctaaatgaaaggtcaaataggtccttctcggcggcatcggcgagcatagcaatgagccccccgctgcgcctgagctcccgctcccatcgcaaaaagttgagttcggtagtcgagggcgcgttgaccacggggggctccagggagcctccaagcggcggctggcaggcctgcaccacgatcagagtctcaacgtcctcccttttgatgggcacgatgcccacgacccaaatcgcccaccaccgccctgcggtctgggtaacattataaaaggtaaccgagctgacgcgggccctgacgctctccgcgggtgtttccatcattgtttgagatctgaggaggactggaccctttaaaacatccggtcacgccctttgcaaattatttaaaaggtgaatgctcaactgagaccatcgcaatcatgaagtcctccaagaatgacacgttcgtctatagaacgtgggtcaaaacgcttgttgtgtactttgtgatgtttgtcatgtcggcggtggtccccatcaccgccatgttccccaacctggggtacccctgctactttaacgcactggttgattacggggcacttaacctgaccaattacaacctggcccaccacctgacccccacgctctatctggagccgccggagatgtttgtctacatcacactggtctttatcgcggactgcgtggctttcatctactacgcctgcggcgaggtggcgctaatcaaggcccgaaaaaaggtctcgggtcttacagacctctcggcctgggtctcggcagtgggctccccaaccgtgctgtttttggccatcctcaagctctggtccatacaggtcttcatccaggtcctttcctacaagcacgtctttctctcggcctttgtgtactttttgcactttctggcctcagttctacacgcctgcgcatgtgtgacccgcttctccccggtctgggtggtcaaggcccaggacaactctattccccaggacaccttcttgtggtgggtggtcttctacctgaagcccgtagttacaaacctgtacctggggtgccttgccctggagacgctggtcttctcgctcagcgtgttcctggccctgggcaacagcttttactttatggtgggggacatggtgctgggagccgtgaacctcttcctcatcctgcccatcttctggtacattctgacggaggtgtggctggcctccttcctgcggcacaactttggcttctactgcggcatgttcatcgcctccatcatcctgatcctgcccttggtcaggtacgaggccgtctttgtctccgccaagctgcacaccactgtggccatcaatgtggccatcatacctatcctgtgctcggtggccatgctcatcaggatatgccggattttcaaaagcatgcgccagggcactgactatgtccctgtctcggagacggtggaactggagctagagtcagagccgaggcctaggccctcgcgcacgccatcacccgggcgcaaccgccgccgctcttctacgtcctcatcttcctccaggtcaaccaggagacagaggcccgtctctacccaagccctcgtctcctccgttttaccgatgacgacggacagcgaggaggagatcttcccctaatgcaataaaaacttaaaacactgaggttactttcccgtcattctttcgggggaacgaggggaggcgggaattgggttaagataggggcgaagggtgggggtgggtgcaagaattggggctgggaatggagaggggagtgggctaggtgccgacaccggggtgccaagataatggattgagtaagcatggggctctgatcgggtccgccgggttctcaggggtgtagtgggtgggcattgcatatttttgccgcggtgctgttgggccttggactcggggtgatcatccgtaccatcacccgcacccgcaccccagtccacagccaccggccaaggtcctgggcctcccaccaccgttatgcctccccctttacccattaattacaagagatgttagtttggttttttatttggcaaaaacagcaattcatcattttcagagtcctcatcatattcgagcccctcgttggtttccccgcaggccctcccttcttcggccgctattagcttagtagtctccaggttaaactcctcatagtcattatacaggttgattattcccccgtccacgtcgcctatggagttgactcgtcgtcggcaaagagaccagagggcacccatggcgcggtgtcaaaagtattgtctgcgtacgctttccaggagccagccgcggtgctcaaggtcttacggatgacagagtccggcaggaccacgggtgtcaccagcaccgccacgggaatctccaccgaggcgtccagaagcaggtctgagccgagcgtgcaggtcgccgggtctagaggcgaccgttttcgaaagaaggccgtcacaatgttcacccggggtgagcagtctctcccgggcttgccacccccactgtggcggacgtagtctccaacaattttgtattggaggagcacctggtagaagtagttgtgccgtggattgatgaagatgttgactgggacccggtctttaataccaatgcgccccgcattttcgcttgggtccgtcattacgtagagcatagactccacccccctgttggcagctaggctgtctgccaccaggtcatgaccggggcccagtttgcgcttacggacatctttaagattccaggcctcatcctgcgtcaacagatagtcaccctccgagggcaaccgcccatccgggacgtactccacggtaggacgagctatagaattgataaatctgataaatgacctcttgcatggcctcttgtaaagcgcagtgtaggatgggtagatggggtcaaattctgacttggaaaagaggtacttgaagcggcacttaatctcataaatgcagctccggtcggtgaacagtataaagtctccctgtgactccacattgacgcaaagatccagagacaccccaaaaatgccatccgtgggactaatcataaagccaaattgacggttggcggatgcgtccccgcagatgagcttacagacaatgtccttgaccgtgtcctcacaccgcaggccaaaggccacaggtcccccaaagtagtgatttgtggagatgggagctggctcaaacaccttggtgggtccattcttaatggtggagagcagcttggaagaggaaattatgccatttcgcaatatgtcccacatcaggttctcagactgccccctggtcatggactccacgtacgagcagagaacagtcctctgctcgtcggtggcctcctgtagcccccagtaaatggatttcagggagggaccgtccttgctgtcattctcttggactaacgaggagacaaagtcacagaagccagtttcaccagagaactcttgtatttgtttacagaggcaatagagatagacaaagcgcatggccggcatctgaggtggacggtcaaggttacggacaaaggcctcagtctccggactgcggaggaagcgggcaaacgtgtaggaggtcatctcctccatgggatcctcgagctcatccacgtcggccatctggaccaaagaagtcgtctgccaagagttcagctaccagacctggaagatgagggtgctcaaaccgtgggcgacagttgaagaagtagctctccttgaacctctttttaaggctccggcaccactgcaagaattgactcatatgctccgccgtgacatccacgcacggactctcgccacacgaggtcaggcccatgtctaagttcaggttccacatctgcgacagcacctccaacagcaccacctttggggctgcaaattgcaaaaagtagagcgggtcggatcggtcaaatcccatgtcagggttggggtaggggattttgtgggtggagtcagcgaggtgcatgataccatagagcagcgagtagccgagcgactgcagatccaggcgaagggccgtctgcgcccccacggggccacacgccgaggggtcagggatgtgcccagcccccctcaagatgtagcacttgctcaaaaggcagaggggcttataggtgtccttggctatagaaaatggttccctctggcaatagaggcgatagagctgccggcccttagaagactttagccgcacatccagcatcttgttgcggtcgtggagggaagcagtcccataatcagtcaggaccagcctacccatgccccacatggtgtctgtgaaatccaccaggatgttgctggggctaatgtccgaatggaagaggccgcagtgccgattcagaaagtaaacggcatctttgaggccctgaaagccccgcaccaggggctcaatactaccatcatgccagtggccataatcctggagactgcatctgaactggggcataaacagggcgtggcaggacgtgcaggccgacaggtagtccaccagggccttgtcctgcccatcctcggccgtggccttcccaatctgaatcatgtcacacaccatgagctcgtgatacagctccgtcacagagtcatagagtttgaccgtggcattatctgcatgtgcatacacggccccgtagctcccccgccccagcagatactcgcaggtaatggggaggtgatcacagcgcgtcatgttctccggcagctttacatagagggtctccgtcatgtcatcaatgttggtcaccttcaggtgtttgtgctgaaaggtgaagtaatcaatgacagtcaccttccccaaaaaggcctgggtctctcgagggggttctggggagacactcaactcgccactgctggaggagttcgtcgggctcaactccgcagccatattcacatccatgttcctcaaatggctcgagggcctgtcgcagctcgtctctggcctcaagctcctgctcacggagctcctccacccgctctagctgcttgtagttgatttttggaaattgagtcttggtcgcggtgaccaccctctgataggtagaaattagctgtttggactcaaacgtctcccttgcgtggcgcagggactctaaggcaccccgagcagatgtaaactgtgtttcaaacagagcgtggtccctcccaaatctgtcacgtgcgctcacagccgctctcttttctaccgaggctcttagttgctgggccaccagatctcgcttagaactactcatcttcataagtcaccatgtccgcaactatggagcccagatcatacgtggggtagagtacggtagttccagtggaggcttcccggtaatttcccacagcgtccaccatatatctttctgcctctcccgttagaattaggcaaggatcatacgtgtccaccggccttttatactgagcgtttaggttttgtttatgtagcaagcacaaaaggcacacacgagtgatgcaaaagggttcctgaggcagcaggcagagctgttttgccattttattcaggcggctaacgtcaaagggaggagctatatcctcacccttccagtcacgcacgtccaagtacagggcatacacacacctggtgaggtgtgccaggaatgcctctatgttggcacatggtgtataaaccgcagtgggtagcagaatagggccccttttgccccgtgccgcagcgtaaacgcagtgacgctcttcgcagtgggacctggggccgtagaagagggcccacatccaagggagtgggtcttcaggcaccagggaggtccaggtttgggagtgggccaatatttgcaaggcctgacctataacctcatctttgttccaggccagcgcaattcgcataaggtccccatcaaacacctcaaaacacagacccatgcccatttcaggctgagagggctccatccggctcgaccaaccttgtccaccaaactgccattcttctggtaaacgggggttgaggggcaagagctccaaagccaggctcgagaagtcatagtcatcctcggccacacggccggagctccgggcctcgtgccagggcctgttgtcctgggggaggatattggacacgagcaggaagctcttgagtggcgtctccaccagcttaaattgctcgggcgtgtcctggcaggcctccagtgccagttccagacactgcccatacctgcgggcgagcatcgggtcatcgggcatatcggccttgaccgcgttgaacatgctgtatgcctcgcagcgcggccgtctgaccgagaacctaagaaacgcccttcagcaggacagcaccacgcaaggctgcctgggtgccgagaccccgagtattatgtacacaggggccaagtcagacaggtgggctcaccctctggtgggcacaattcacgccagtaatttatattgcccaatgcttcgagcatactgccgccactatggccccaggcccgtgtttgtagcttctgatgaatcattacccatgttcggtgcgagccctgcccttcacaccccagtccaggtccagatgtgcctactaccagagctacgcgacacgttacagcgcctgctgccaccacccaatcttgaagactccgaggccttgacggaattcaagaccagcgtgtcctctgcccgtgccatccttgaggaccccaactttttggagatgagagagtttgtcaccagcctggccagcttcctgagtggtcagtacaagcacaagcccgcccgcctagaagcattccagaaacaagtagtgttacattctttttattttctgatctcaatcaaatctttagagattacagacaccatgtttgacatctttcaaagtgctttcggattggaagaaatgacgctggagaagctgcacatttttaagcaaaaagccagcgtgtttcttatccccaggcgccacggcaagacctggatagtcgtggccatcatcagcctcatcctctcgaatctctccaacgtgcaaataggctacgtggctcaccagaaacatgtcgcgtccgccgttttcactgaaattattgacaccttgaccaagagcttcgactccaagcgtgtagaggtcaacaaggagaccagcaccatcacgtttaggcacagtgggaaaatctccagcaccgtaatgtgtgccacctgcttcaataagaatgtaagacctgacgtttcagtacttggcaattgtagagcatagcccggctgtaaaggtcagaaaatcgcagcagggtccaaggttgtgctgtacatgggacctctttcccattagcaagaaccccctgcaggacacgtgacatgtccgggtgcattttgggtgggttaaatctcagtcccaccacaaagggggcatcctccggtttgaacatcagacccaacaaagcccgatgcccagttatgggtacgtagtcgttgttcagggccgtgcatggcagcagacaaggacaggtgccagatgtgcctgggctatcgtcctccgtccagccacgcaggatgttcacgtgggccccggcaccatagcatgtcacacattccccgttatcacatctggttagcaggttgataaaatgggtcagtgatggaaaggttggcatattggggcagcacatcagcatgtccatgttaacgaaaaacatgtacagggccccttctgcataccaggcaccaccccgtcccagtgggatgatctccgagggtgtgatatcttgcagttcttctactgttttaacggcggttgaggtggtaaagacgtgggccgtggtcagatctgtgcaggtgactacagggttacccctaatctccacaggcaccgcctcacccactgcatctgagaataccccaaagtacatgagagtcaggctgtgtggcccctggactgccttagtgaagagaacctcgggcctggccacggtggctagggttccattgatgtagacggtcacataggtgggcttcttcttgggcttcagcacaatgagggtaacattcatgtaggttttaggaggtccggctatctgaggcacgtacacagctgacacggcggttgtggccgtatagactttcatctggggcgtagaggcatcgctcagcacccagaggcactccttgttgaggaacttgcgaagctgttcccggctactgttcgcggcggatgccatgacgtgccagaatatatcccctctcctcgggggtgagtgccaattggcctttaataacaaagcccccaggcagcaccaaaaatgcctgcccgtccgatgtggtggccaggtggacgcagtgcccgtcagttccaagggctactagctgggaagcagccccaaccagcccacccgggggcctggagtcgatcaccttaccccaggccgaggccccttcctcatacagcgggtggctatctatccataggcaggcatccggcgtctttggtgcattggagatagtagctttcacccaacaactttcccaactaacccgtgtctggacagtgaagaacgcttccctgatcaggtctgaatttttatagatacgggagtaggaggtgggaataacaactgggatttcttgttgtgctgtccaggcctgcatggccagtttttccctgaagctagcagaaattctgagggccactgaaatgaggaagcgaaactccctctctggagctcccaaaattgaaacctcagcaagatctgttgctggggaggcatgggtgacagctgtcatcctgtgcagtctgccctgggcactcagctctggatatgtgacaacatagagagcgtgggggctaaaaatatgagcaattcccctgaccagggccctggactcacgaatggcccgacgggtcttagagaaagaaacaggcaccctcgagagtgcccccgacccgacccccacagtgccgccagtccctgctcggcctccgccgccttccccaccggcgctgccccggatgttgctggggttctcgagggctgggtggtgcttggacacagaggtctcagcagccgccttggtctcggccccggccctaagtctgagccccaggcaaagggccggactcccagcgtggcccaacctctgctcccctctattctcctcttgcgttatctccaatagaatttgcttgaggtcatacgttttagggtgctcgacctgggccgcggccaccggcatatgctctatacccgcccctccggggggcccaggatctataggtatgggctgcatagccgcagcagactcctggaccccagaggcctctctgataagatgcccgtcggtcagagcccttttggccccctcaaagagagacaggtaataaatctgtagctccccaaccagccctccttcatcgtaaaatcgaagggcggccacgtggaaggggttgtagagctctggaaggccctcatcgcagtacactggcacactggtaaacgtgccccgatggctaggccgtccgggcagcatgccccgagcagcaaacacgcggcagaccctcgtgagacccgtccggtcactgaagagagtctggcaccaggccccctcgcagtttggcacgcgattggggcaaagctctgccataaccgtgtcgggaacaaataggtgcacgaggaggggggtcccgaggccactcaacacttggttgtcaatgtggacatccatagctctctcatgcgtttggctacagcatcatagcgcttgtttctggtggatttaaataacagggccccgtagacagtcttttgtgagtaaatagagatgatgacatggatgtagagactgaggaccacatccaccaccttctcggaggaggcccccctaaacagcatcaggcagcaagggaacacaaaggaaaccagggccgggatgtgaggcctcagcgccccctcctgatcaaagagggcctcgctgaccccggagatgacattctcattcagaaagtagtgatagaggtgattgaccacagtcttaaccaggccctggacttgttcaggctcccacttgtcccgctggtcctgtgtgtcttgtcggatctcggtccagggcctcagcgccggctggaaatgcggccccatgtagttgcctgtaagggcgcacaccactccctcatgggtctcaatcagggtgcactcgctggatccatcacatacgtggtactcgccacagccccagcaggcaaacacggaggccatgctctcaggtaacgggagatggaactccagcttactatacgagcacaggtggcgaggattgggctcatccgtgcccccctccccccgcgggaggctcaatcggccttggtctgacattccaccccggccaggtccaggagggtgcaaatattctccaggcgctgcacctcagagacctcctgctcaaagagacctcccaccgccacgtagacgcgggccaccgtccggggaaggtcagtggggtcccagctcagcaattctccaaattctctctccccaatagtgcctcgcttcttatcctgtctttcagagcatccgggggcagacatttcacctcttgtttgtggacgaggctaactttatcaagaaggaggccctgccggcgatcctgggctttatgcttcagaaggatgccaagattatcttcatctcgtctgtgaactcggctgaccaggccaccagctttctttataagctgaaggatgctcaggagcggctgctgaacgtggtaagttatgtgtgtcaggagcatcggcaagattttgacatgcaggacagcatggtctcatgcccctgctttcgcctgcacatcccgtcctacatcaccatggacagcaacatccgagcaaccaccaacctctttctggacggggcctttagcaccgagctgatgggtgacacctcctcgctgagccagggtagcctgagccgcactgtgcgtgacgatgccatcaaccagctggagctctgccgggttgacaccctcaacccccgagtagccggacgcctagcctcctccctctacgtgtacgttgatccggcctataccaacaacacatccgcatcaggcaccggaatcgccgccgtgactcacgacagggcggaccctaacagggtcatcgtcctgggcctggaacacttcttcctcaaggacctaacaggggacgctgccctccagatcgccacctgcgtcgtggccctcgtctcctcgatcgtcaccctgcacccccacttggaggaggtgaaggtagccgtggagggcaacagcagtcaggactctgcggtggccattgcctcaatcattggggaatcctgccccctcccctgcgccttcgtgcacaccaaggacaagacgtccagcctgcagtggcccatgtacctcctgactaatgagaagtccaaggcctttgagaggctcatctacgcagtgaacacggccagcctttctgccagtcaggtcaccgtctccaacaccatccagctctccttcgatccggtcctctatctcatctcccagatcagggccatcaagcccatccctctccgcgacggtacctacacctacaccggcaagcagcgcaacctctctgacgacgtgctggttgcgctagtcatggctcattttctcgcaacaacacagaagcacacgttcaagaaagttcattaaactttattgactacaccagtcccttgtaaagcgacgggtctcgcgtgacggcattcgtgagcagggcttcgtccaggggcttgttcttggcggacatcattagcccagccgcaaatatcagaattagcatcagaaaagtgagccccacaaacaccagtgtccagagaggaagaccgtaagataaagatggctgcctctcatctggaacggtgggaagctcagcagttgtttttgtggcattggacgtccctttggaggacagcgtgggggccaaggtggtagcgttggtaatacgggtagtagcactggtggtggaggaggacctggtggtgacattgctagtcacacccgtggaggttcctgttccggcctcggtggcagtgatgttctgtgcagtaaccttagtggtgacattgatggtggatgcgttggaagttgttgggactggtgtgacagttgtcccagtgaatgtcaccgtggttgtgttggtgctcagaatagcagttgtggttataggggcgctagtcgtggtcaaggtcgtagactggtttgtgctaggacccgatgccgacggtgatggtgtagtcacagccgttgtgcctgtcacgttccccgccgaggccgtcgaactgccactagatgtccaaataaggcttgtctcacagatgagtatcatggccataacagcgcctgccttgtctctggcgtgtgccatcgcgtctggacgcagaaggcctcccggcctcttttatagctagtctccacacccaatactctactgaaccatcacatacatgacctcctcgaggtatgcagggaatgagcggtccgtgagccggtcaacacgacattgcttccgtttcatgcctccagctgcccctgaccagttaggacccttgacggatgtctttaacggcgcggtgcagttggtcaccaatgacggcctaaaggccaacacatccttgaagcagggcgtaggaatggtaccaaactcggggcccaccccatcaaagacataatatgtctcatagtggcagtgatgatgcatcaccaccacagcactcgccaggaccctctgcatatcttgtacaaggcgcctttcaactcggccactggctctggtgacgttaaatgtcctgttcctattagtcacagcctgtagatttgggcacccagactcaaaaagtgcagctacatgaagggcagccgcctcaaatccaccatgacccccatggctgtccgtgttgttggggtaataagtcacattgttaatgaccacggccgggataagggtgtaaaccttgcagaatggattggtcggacacccataagacaggggcaccccaaaatcacgccccttaccccgaagcaccttggcccccaccggcataaagctgggcaaaaagagtgggttaaaaccaaaggcgagtagggccaggaacgccaaatagcagcagtaatagatgaaaacaaagctcagcatgaaacagcgtggaggctcagctagggtctctgcctctccatcatagacatcttccttgaatctcattctctcaccgcatacctcgctcttcatccaggagggggccatggctgccattctaccagttaacgaggagagagagagtaggtccgcggaaattggtgcccctctctgccctcctgacgaggccatggtgtcatccatctccgcagtccgttcttcagctttggcattggtccgggtccgggtggtctgattttgattctgatcctgggtattggtcttggtctctcctcccccattggcatggattggcataggtgggtgtggctcaggctcaggttccggccctgggacggcagcagccgccgggacggtgaagtcgtggaaggtagaggcccgtccctcccgaggtcgtggggccggagccttataaaagacttccaccctctccccgctggccaagacacgccgctcgtggaccacgccatcttcctcccggctgattgtgtggctgacggtgccgtgttccaccgccacttgttcatcgaccatggtaccccctttatcttaaccagcaagtggccgtcagggtctcttgagagtatgccgctgtggccaagcgaggccccaaattaaatagtgatgccaaagactgtaggtaggtcatcatcacacgcatgcgtgataaatcatccgccactgacaggtcatccaggtctatccgggctatctcatccggcaccatttcctggaagagattcaagaggtcgtgatgctcatgccggataaggcctcggaccaggcgcatactggccctgggcagcagggtcaccatgatgcaaaagtagagactcagattgtccagcagggccaagccaaggggccctggcacctccgggagggccaactcgtagtggtgccccaggtatgaaacagagccaagatgcatgtgtacatcgagcatgtctgcgttcccgggagcctgcatgacaacccgggagtacacgttaaacaggagaatcttctgcagcacctcctctgctatgggcgtaggcagcaccatggggaaaacaatgtccacatcattggactctaacttcacggtggcatgctctcgtccaaataccgggggcataacactgaggctcccggtcccatgccactggaaaaagggctggtacttgttcttaatggcgtaggtctgacctggaacaatcttggtgagtatcaaactgtccacgctaacctcatccagcacggccagggtgcaatcagacaggtagttgtacatggacacgtagtccgggaccgtctctagagagtacacctgacccaagcccaatccctgcacattctgcgtcccgtgagtggaagccaggggtaagatgcagccaatcctctgttgcatcttggcaatctcatcggtatacagacgagaggagagagacactaccactttcaaatccatctttattgacaattatcaaaaaaccaccttatttccaaactttaatattcttcgtaccggcgccacctcttcaattatatagtgtccgtaatggatgggggcgtgggtctgtttgacagacataaactcatcgatgagtgcccgggaggaggctgagagtgcggggaatgcctcctgcagaaagctgcagggctgctccagaaacacgtcagtgccagcaatcactacaaactgcacctctgtgttgctggtggctgggtgccctccaagtcgctggctgtactcgttgaccatgttgtagagtcccctgttgttgcgcagaagctcctccttgttgaaaaatgcccggcaggggctgtagaggcccgggacggccgtctggcgataggaggagttgtacatgatgtcacccagagaacccagctgagatgcccagggattcacagtgctccggtattcataggcggcatccgggcgagaatggtcatagatgagcccctcggcaacctcctgattgtagttttcacaggagaccacacaggcggcccgtccccttggagagttggacttttgaaaataagccacgtctgccgtgaccggtgttacgataatctcacaggtggcctgctggccgtggcagagtcctggagctccattaacattagtcatacctgccaggtatgtcctggggtcccgaagcagcgtcccattgcgctgagcgcccaccttggccttgatgtagtcattgacttgctggttgccaaaggcctcggccggaaagacgctaaagaagtcttgggtgtggatacccatgtcagtagtgatggccgccaccctggccggagtcatggtcgagctataactaagcccggtgtcgatggaggccatctcgtgatgcacctcaaaggttaccgcgtccaccctggcctcccggcggctaacatttggggtcccaatgaacatggatgttgaggccctggagctaaacaatatgttttcagagaggatctcatcggtcctgaccacggtcatggccacccctgggtggatcttgagcttggcctgggcaatataggccatgggggacatcttgatgtgcatggcggtcattccactgattgaaacgagggaaggaagacattcggccgcgtatttgcccatgggcgagcggtgccactcccggtactctgcaaagagctgctctggccggttgaaggcttccacggcccgctgctgaggattgcgcataacaaaggtggcaacatcctggtgcatggtggcagccactcgcgggtccccgtaaaacatatggaaaggaatggcgtgaaagagacactgggtgacggcccgggtcctctcggagaaggcaaaggccaccagcccgttcaccaaaacagtctgctctgtccgcttgtcggcgggattcggggccagctgctgcgtaacgtcattgtccaccgacacacgcacggcacgggtgaaagtggggcaggtcatgaatgaggcgctgaggtccctgatcatgcccacggtggggcggaggtcggagatctccagcagatccctgagcgtcccattctccaaattgtcgaggatgtcctcgtccctggtaaaatggtggctgaaggctggcccgttgtaggccagggtctgggccacgtgctgaaagtccaccccgaggccgcacatgtgggcattggtgcaggttgggaggaaaacgtagtaaaagatcttttccagcacatccgcatgcccctcatctacataagggcctaggtgcagacggaaatcgtggtcgtggtctccgttaacccggtagccgtacaaggccacaaattgggcagccatctcatccatgtttccaaccctctcaataaactggggcgcggccagggtgtcagcgtaaacctcatttccgataataatctggggggcccggtcactaacggtgagaagatgggtgaaaatgtctgtgtaggccaccggggggagcaggttagggtccaggagagcgcagacatactgacccacgctctcatcccccacaacatctgacccggccaggcgcatcagggcctgctctagggctataagttccccatagatttttctatacatggaataggcctccttggagatggcgttatttcccaggtggcggcagatgaacttgatcatggaaaagctgttcacaaaggcaagcctccctgaccgttcccagtaggtgttgatgcacagggacaccaaaggcacgttcatgacaaacttttcctcaaacccgtggatcatagcctcgactacgtagaagaaggctggataggcagtgtcataggcagtatcctgcacagtctcaataacggcctgatccaccacgtgggccagagatgtggcggtctcaaactgctgcccccgggcctcttggaatgcagctggggccaggggagtcggcaggttacccaccattagccggtgcacagccctgtgcctggccctctccccggcatccctgccaatgtaaatatcataaagggggtgcagctccagccgcagcaggtcataattggacgggtggaggaagtcttcggtgggcagcccgcacttgagagctatatctgtcacgggggctgcatacttgttatcatagaactcgtccacaataacaagcacattcatgtgattgggcctcctgtgttgcagggagtaggtctcgcgcctgtctcgcggggccggggccgcgttgaggctgtttagggtatgggcgggtgtgtggagtcgggggtgacagagaaccttgagagcattctgtaggttaaacgcgaggagaaggttattcttgtttacgatccatgcctccaccggtagctgctgtgtggggttgtccagcattttgatggcggcggaggtcgtgtacttgggattgggcataaacaggcccactgggaaatagtagctgtactgcattcttctgttgagggggtatggggactgagtgtcattgtacatcttttgcaggctttccacggccaccgcgtggttgcccagcttgatgacggcggctgagatcggcacccggggctgatcctcgacccctgcggccacagccggcaggtcagacttggtgcttccggctttttccggtgagtccacgatcctagccatgaaatgctcaaacgtacgcatcacgcgcccgtagctcacggcagtgaccaggttctccccccgtaccacaaaagaagcatagctcgagggccccataatctggttgtcggcctcctcacccaggaaggtcaagagctggcgcagaacgttgtcggtgacaataaacaccccccccactggctctccccccttggcggtcgtgtaggtactgacccccttgagcacgctctccccggacacggccgctaccatctcagagagacggcttcgcacgtactgagaaaacccggagcccatgttctcggcccggtccaggaagaaggagtgctccagcagatgcctcttgaacatggcaatgaggtcagacttgacagtcttggagaaccccctctcagtgaaggtgggatccgccagggtctgcaggataaacatgggaggggcatggcgaagcttcacactcaggacggtgttaatgaggcccctctccagggcatcgaccccaaactgtagggccgaggccacggtcttgacagcccccacgtactctgcgtactcgaccggggtctcggggatactatgcaggatctccagatccagcatggacagttccatttccgtactaatgtggtgtttgtggcaatttttgaccacaatgaatgtccgctgcttgctgggtctccttccgtccccgtgagcaatggtggggacggagattcgaaattgaatcttgccatccgtcatacgactcaggtctttgaattccgtgttcacacaggacacggccagtgccgtctccaggaagcgaacatattggatggcgttcgtgtagaccccgagtagcacctcaaacttgatgcccgcctctctggcatccttgcccaccagcaggtcaaagctatgaaacaacccctcagccgctgactgccgcaggttcgagagcaggtcggcatccaccgtcagataggggaagggtctgttttccacaccctcatttgaggccatgacacaaggtaagagggagatggggggaggtctcgagggcttctcttcacagctgggtctcttttacgccctggcctgcaaccgcagcccacccacacttcccgaggatgctacccttctaatcaaatggttggacacggccctgggcagggaggccaccttttacgcgtgtcgggctatgcgtcggcttctactcggcgttatccgaatgaatgactgccaggagctgccacccggtttaataattctgagtccgggcaccgtccctggcccccttggagtccagagtctggagcatacagactgcgaaatatggtcctctgcccaccctgaccacgctgcccacctcccggtgcccagggtcatcacatacaccgactgcccgggttccataaacacgagctcaatgtttcgccttatcatccgctacttgtctcatcaccaatttgagcgctgcttcgagcagttctgccgcgtggtcccgcgtcgcttcctagggacctgtaagcgaaactctgcaaagatgctggctcatctgaatcaggttaccaggatccccccctgtccgcccttcagcgggcgggaggccagactcaagttccacttcttctcctggagcacattcatgctgtcatggccaaacaatgccacactccgggagatcaggacgagggccgccaccaacctcacccaccacccacatctagtggatactctgtaccacgcctctccgcagaccccatttctgacacgcagcggtgctctataccgcttcgtcacctgttgcaactgcaccctgcccaatatctccatccagcagtgcaaggccggggacagaccgggggacctggagatcattctacagagtaacggcggagggaggcccgcgagcttccagttcccctcctccccaactggctccctattgcgatgcatagttgctgcgtccctgctgccggaggtgtccgtggggcaccaggagctgtctccgctgcggtccagaagccagggagggcagacggatgtcaggtcgggcccggacccggcccggagactggtggccctcctgcgaagggaagatggggcacctaaagacccccctctgggaccgtttggacacccccgggggcccggcccggccaagagcgaagacgaggagtctgagcgtcgagacgcccctccacccccgctcgattccagcttccaagcttcccggttggtgcccgtggggcctgggtttcgcctgctcgtgttcaacaccaatcgggtgatcaacactaaattggtgtgctcagagcccctggtgaagatgcgagtttgcaatgtcccccgcctcatcaacaactttgtagcccgcaagtacgtggtgaaagagacggcgttcaccgtcagtctattctttacggacggggtgggggccaacctagccatcaatgtcaatatcagtggcacctatctgagcttcctattggccatgacgtcactgcggtgcttcctgcctgtggaggctatttatcccgcggccgtgtcaaactggaactcgactctagatctccatgggctggaaaatcagagcctagtcagagagaaccgaagcggggtcttttggactaccaactttccctcggtggtgtcctgccgggacggtctcaacgtgtcctggtttaaggccgcaactgccaccatatctcgagtgcacgggcagacattggagcagcacctgatccgtgaaatcacccccatcgtgacgcatcgagaggcaaaaatctcccggattaaaaaccggctctttaccctgctagagctacgcaatcggagtcagattcaagtgctgcacaagcgtttcctggaaggcctgctagactgcgcctccctcctgcgcctggatcccagctgtatcaaccgaatcgcctccgagggcctgtttgatttctccaagagaagcatcgcccactccaaaaaccgacacgagtgcgcgcttctgggtcacagacattcggcgaacgtgacaaagctggtggtaaacgagcgcaagacccgcctggacatactgggccgtaacgctaactttttaacgaggtgtaagcatcaggttaatctaagacagtcacctattttcctgaccctcctgaggcacatccgccgacgtctgggcctgggccgtgcttccgtaaaacgagagattacccttctcctggcccacctgcgcaaaaagacagcccccatccactgccgtgatgctcaagtgtaagcagcccggggcccgcttcattcacggggccgtgcacctgccatcgggacagattgtcttccacaccatccacagccccactcttgcctcggcgctgggactgcctggggaaaatgtacccatcccggccctcttccgtgcctcgggcctcaacgtccgtgagagcctacccatgaccaacatgagggcaccgatcatctcgctggctcgcctcatcctggcccccaacccctatatcctagagggacagctgacggtgggcatgacacaggacaacggcattcccgtgctttttgccaggcctgtcattgaggtaaaaagcgggcctgagtccaacattaaagcctcctcgcaacttatgatagcagaagactcctgcctgaatcagatcgcccccttttccgcatcagagcaccccgccttctccatggttgagtccgtaaaacgagtccgggtcgatgagggagcaaacacccggcgcaccatccgggatattctggagatccccgtgactgtgctctcatccctgcaactgtctcccaccaagtccatcctgaaaaaggcaccggagcccccacctccggagccccaagccaccttcgatgccaccccctatgcccgcatcttttacgacatcgggcgacaggtgcccaagctgggcaatgcccccgccgcgcaggtcagcaacgtgctcatcgccaaccgctcccacaactctctaaggctggtgcccaatccggacttgctgcctctccagcatttgtacctcaagcacgtagtgctaaagagtctgaatctggagaatatagtgcaggactttgaggccatcttcacctccccgtctgataccatcagtgaggctgaaaccaaggcctttgagaagctggtggagcaagccaaaaacaccgtagagaacatagtcttttgcctcaacagcatctgttccacctctacactcccagatgtcgtccccgatgtcaataacccaaacattagcctggctctagagaagtattttctcatgttccctccctcaggcaccattatgagaaatgtcagattcgccacccccatcgtccggctcttgtgccaaggggctgagcttggcaccatggcacagtttctaggaaagtacatcaaggtcaagaaggaaactggaatgtacacactggtcaagctttattacctgctgcgcatctaaaggaaaaacataacaatcttgtgaaccagaaagatacccagagcaaaagcaataaagtacaggattattgccaaaacaacgtgtgctctttcttcatacaggcccgcaatttccatgacagtcccgttggtggtcagcagcagatagtgaacgtggaggttgtcaaaatcaaagtagttggagctcaagatggagttttggacttcctgggaggtgatgtaggttgtagtttccaggccttccttttcatcataactgagcagggcaaagccacaaaaaatgcaggatttctgcgtcctggtaaaattctggatctttggaatctggcggggctccccagccacagcaccctgcgaacatttattcattataacgggggagagaaagagagagctgctgagataggtggtgctggcctcgtatagcgccgagcctcggacctcacggtcactagagattatgaatgtcacattgatgagcgggataatcatcagaactttgtcgagcctgtccacgcatttgtaggcggggagatgccacgcatccctgtcttctcgctccaaagagagccgcccaagaaacccatccacagcatttgaaacggccgcctggtccagcgttgcctcctggggggccatgctcagcagcttgtctcgtgtgaggtcaaatcgtaggctgaggtagcacggtgagaagagcccgctctctgtccccagggctagcccccgcaaaacctccccaatctctagggccgagcacagggcggtggacagcagttggtatagggcaaggttgggcccctgggtagtcacgttcagccgcaactcgcgtagcaccacgtggctgccgataaacagggtctctctcatcacggtatgcaggggctggaaaagggggtggcggttgtaggccgagagaagcacagatgtggcgcctccaatgaggccactgtaaaccccggccttggggtagccgacggtggctaacctcagcgcgtactcctgtttctcagtagtcaggtgacccagctcctccatcttgaccgtggccatcagcatggcggccaagcgctccagcccgtaggattgcatgcccttgacagtggccccataacatatgccgatgatgtctttcaggacagtcagctcaaagaagctcttggccaaccagcggaggtccacgcagccattgccagtctcacccacagcatgacccaccttaaagaaggccacagaaacctcaaacatggtagtcagcgtttccgtgtccagttccggctcccggcagcctcccttcatctccagcaggaccagtttctggagaacgtagcgagcgtagctggcggctgtcatggtgacggctcgggaaaacatatccttcaggttgggtacaaagtagttgtgaaagttggcataatgcacaaaggttgtaacaatcaccagggaatagtccccgctttgggcactggttaaggatgggtaactaaaaggccccctcagatccggcaggtccttcgtcttgccaaagaccaggctcaacacatgctcatctcccttctcggtcactcgcttgtaggtgcccatcagaaatttagaagtcatggcccccgtgtactgaaacttgtccccgttgatggacagggccacataagacaagtgacagcgcagctgataaaagacatagctgtgtggccgcgtgttgggcagcatggtgccaatatagtagaagagctgcttctcaaggggggcactaagcatgcaggcaggggaattcaggccgctaatgactccgggatggaccttagatgcatccacttgcatggatccttcagagacagcagggatatcgacaggctcggccagcgcaataccaagggtaccagacgtcttgtaaattaacttgtagcggttaagcatagacgccaaatcttcggtgacatttgcctctctccacagcgcctctgggctaaggcctgggacctttgccatcagttcggtccatgggatggtgtaatgcgaagcatgcccctctatgtccaggtgcagcttaacctcgctgaggctggcagcccccacctcccatagcaacaccaggcaaaaaacacagagcaactgcatcctagtcccgatttcccctctcaaaatcagagatcaccttgctcagaccagcccaatcgaaaaactgagatcgtattgccggattcttcaatgcctgcatgtaaatctccgtccagcatccaggtaaatcgtcctgaaactctgagaggtccacaagcacaaactgaaggtaggctagcgttcgggtgaacgcaagacaaacttccaacaacaccgcgtcggctcggaaaggctgtatgacttccttaagtacactaaagatgctgttcttatacagcttctcggccacaccacttcgaattatgggggtgtggctttgatgacatactgtcgtgattgttgttagaccggcacataccttcacaatgtcctcgggggcaaaatactgtgttaggagccaggcacagtaaacggcgtgatatgcatcgttgacactcttcaggtagccagcatccagtcctgactcatgtttcctccctcgcttcttcaggcggcgcatgttctcctccacgtttaacttcatccagactatggtgtcccccgggtctgcggtaaacgtggccaaaacttgaataaagtcactataggagagaagctggctccggagcagcattagagggaaaaccacggaggccgacagcaaatggcgatcatgcaaaatccaacaatccaggggcgcgactgacctggcaccagactcggtaaccagcaagctccgcttcctagaggccaagactctgaaaggggtggtaaatttcatctggcatgctaaaacctcagccgacgtgtcttcccttccatgcctcgcccgagtcacattcttgtgcatggccttaatggcattttcatacacatgagtccagtaccgcatcggttcagggactacaatggtcaggtccccaaagacagccttcaaatgattcagcatagtagtctttcccacaccaggggcaccttccaaaaatagggaacaggcaggtttgattactggtacatgatttgttaggtgggtcacaattggaacccgcatgctctccttcctctgagccttggcctggcgggtgtcttgggcatcatccagattcagaacattcatcacactcccacttagccgcttcagctgggcagcatgcttggataacttactaaactcgcgcccatgggcggccaggtgttcgaagagaccagaaggcttacccttgccaccattcttttgttttaacgcggaatgagaagagggcctgcggaaattagactcatcctcagactcacagtcagatttgtcatcgagcccaaggccggccaggccctcctcaaagcctttctggtacatgaagctccggctcgtggagtccgcacctccttctgtgcacgaagttttgcggaaccaggagaaggggtctggcgtcttgctggggccacactcccggctacggggcttcggggtaggggcagtaggcttttggtgtgcgggtgctggtggctgggctcccctgggcagggtaaaggggcacgatgtgtgccggctacccggagagtttccagtattagatgtcacggcagcctgggtccggcacggcaccctctccccagacagtccggtcggagccatcaaggggggccagtgggtgggcacctggtagaggccgtcgtcatcttcctcacctgcccctgagtcactaccggttggggtaagaactgagggggcaaagtcatcaatctcagcgtaaaagttttcgtgtctttcgttttcaggggactcatcctcctgacattttcgccagccgccgggcgggccggcctcctttcctggaaatccagccatggatcccacccggggtctgtgtgccctctccacacacgacctggcaaaatttcacagtcttcccccggctagaaaggcggcaggtaagcgagcgcaccttcggtgttactccaagctgctctctcttaagagctgggagcaactggcctcttttttgtctctgcccccgggacccacgtttacagactttagactatttttcgaagtcaccctgggtcggagaatcgcagattgcgttgtggtagctctgcagccttatccccggtgttatattgtagaatttaagacggccatgagcaacacggccaacccgcaaagcgttactcgcaaggcacagaggctagagggcaccgcccagttgtgtgactgtgccaattttcttcgcacgtcctgcccccccgtgctgggcagtcagggcctggaagtcttggcggcgttggtatttaaaaaccagcgatccctgagaacgctccaggtagagtttccagccctgggccaaaagaccctccccacctccaccaccggcctgctaaacctcctctcccgctggcaggatggcgctctccgggcacgtcttgatagaccccgcccgactgcccagggacacaggccccgaactcatgtgggccccaagccttcgcaactcactgcgcgtgtcccccgaagcgctcgagctggcagagcgggaggccgaaagggccaggtcggagcggtgggacaggtgtgcccaggtgctcaaaaataggctgctccgcgtggagctggacggcatcatgcgtgaccacctggccagggcggaggagatccgccaggacctggatgctgtagtggccttctctgatggcctggagagcatgcaggtcaggtccccctccacgggagggcgctctgcgccagccccgccctccccatccccagcccagccgttcactcggctcaccgggaacgcccagtatgcagtctcaatctctcccacggacccccctctgatggtggccggcagcctggctcaaacgctgcttggtaatctgtacgggaacatcaaccagtgggtaccgtccttcggaccctggtacaggaccatgtcggctaatgccatgcagcggcgcgtgttccctaagcagctgaggggcaacctgaactttaccaactccgtctccctaaagctgatgacagaagtggtggcggtgcttgagggcaccacccaggactttttctcagacgtcaggcacctgccagacctccaggctgccctgatcctctcggtggcctacctgctactccaggggggctcctcacaccagcagcgccccctccctgcctcacgggaagagctgctggagctgggcccggagagcctagagaaaatcatcgccgacctcaaggccaagtcacccggcggaaattttatgattttaacaagcggaaacaaggaagcgcgccagtcaatagcccctctcaaccgacaggcggcatatccacccggcacattcgcggacaataagatttacaacctgtttgtgggagcgggactactgcccacgacggccgcgctgaacgtgcccggggcggcgggtcgggaccgggacctggtgtaccggatcgccaaccagatctttggggaggatgtgccccccttctcatctcaccagtggaacctgcgcgtaggtttagccgcactcgaggccctgatgctcgtctacacgctctgcgagaccgccaacctggccgaggcggccacccggcgtctacacctatcgtccctgctcccccaggcaatgcagcggcgcaagcctgccatggcgtcagctggtatgccgggcgcctatccagtccagacgcttttccgccacggggagctcttccgcttcatctgggcccactacgtgaggcccacggtggcggcagacccccaggcctccatcagctctcttttccccgggctggttttgctggccctggagctgaagttgatggatgggcaggctccctcccattatgccataaacctgaccggacaaaagtttgacaccctctttgagattatcaaccagaagcttttatttcacgacccggctgccatgctggcggcgcgcacacagctgcgtctagccttcgaggacggcgtcggtgttgccctggggcgcccctcgcccatgcttgcggcgcgggagatcctggagcgtcagttctcagcctcggatgactacgaccggctgtacttcctgacgctgggctacctggcctccccggtggccccaagctgagccagttcctcgcactggagtgggtcattggcaaaaaggtaaataaactcatcgcacgggggttttgcctccttctcgtctcttgtttcgggtaggggagtaaggccgtgccaggccgccatgctcagggccacggcgtgccagaggccctcgtagtcgtgcgcatccgagaggatggcacggtccagaagcagatagccggccaggcagaggaaggccacaaagagggggcgaaggcgtgcccgaacccgggtttcatgctcgtctgcaccccagtggacaaggcagtagaggacacccaccaccaggcggttagggaggacactgccaaggttgaagagcagatttccgtcagccagggtgacctggctcaggtccggcgccctgcgcagtccaagctgcgcccacacacatgcacagacggcccctgtgacatcaggccggtcatgcaaaaacagacaaagagaccgtgagcggttaccggggcgcagggcctctgccgggaagcccacccgggccagggcccggtaaagcaggtaccagtattcatccggcaccttgcgtgccaacacacgattcgtgcggtttccagtatttatcacggcttcccgccacaggtaaaagttaacacttagggtcagcagcttggtcagggataggtgcaaaaacctgagctcgtcctcgcgcagagcgcaaagcggccagttctttagcatcttcaggaggagcccgtgaatcccaggtgtcattcgcgcgtcatccccgcgcacccccagtcccattaacatagcgggcacaatggtgcaggcaccgtctgtatacgtctgcggcttcgtggagcgcccggacgccccacccaaggacgcctgccttcacctggatcccctcaccgtcaagagccagctccctctgaagaagcccttgccactcacggtggaacacctgccggatgctccggtcggctcagtctttggcctttaccagagccgagcgggtctctttagcgcagcctcgattacctctggggacttcctgtccctgctggactcaatttaccacgattgcgatattgcacagagtcagcgcctgcccctccctcgagaacccaaggtggaggctctgcacgcctggctcccctcactgtcactggcctccctccacccagacataccccaaaccaccgcagatggaggcaagctgtccttctttgaccacgtgtctatctgtgccctgggtcgtcggcgcggcaccacggcagtctacggtacagaccttgcgtgggtcctgaagcactttagtgacctggaaccgtctatcgccgcccagattgagaatgacgccaatgccgcaaagcgtgaatccggatgcccggaagaccaccctctgcccctcacgaagctcatagctaaggcaatcgatgctggatttctgagaaaccgcgtggagactctgaggcaggacaggggtgtggccaatatcccagccgagtcgtatttaaaggccagcgacgccccggacctacaaaagccggacaaggcacttcagagcccaccaccggcctccacagacccagccaccatgctatcaggtaacgcaggagaaggagcaacagcctgcggaggttcggccgccgcgggccaggacctcatcagcgtcccccgcaacacctttatgacactgcttcagaccaacctggacaacaaaccgccgaggcagaccccgctaccctacgcggccccgctgccccccttttcccaccaggcaatagccaccgcgccttcctacggtcctggggccggagcggtcgccccggccggcggctactttacctccccaggaggttactacgccgggcccgcgggcggggacccgggtgccttcttggcgatggacgctcacacctaccacccccacccacacccccctccggcctactttggcttgccgggcctctttggcccccctccacccgtgcctccttactacggatcccacttgcgggcagactacgtccccgctccctcgcgatccaacaagcggaaaagagaccccgaggaggatgaagaaggcggggggctattcccgggggaggacgccaccctctaccgcaaggacatagcgggcctctccaagagtgtgaatgagttacagcacacgctacaggccctgcgccgggagacgctgtcctacggccacaccggagtcggatactgcccccagcagggcccctgctacacccactcggggccttacggatttcagcctcatcaaagctacgaagtgcccagatacgtccctcatccgcccccaccaccaacttctcaccaggcagctcaggcgcagcctccacccccgggcacacaggcccccgaagcccactgtgtggccgagtccacgatccctgaggcgggagcagccgggaactctggaccccgggaggacaccaaccctcagcagcccaccaccgagggccaccaccgcggaaagaaactggtgcaggcctctgcgtccggagtggctcagtctaaggagcccaccacccccaaggccaagtctgtgtcagcccacctcaagtccatcttttgcgaggaattgctgaataaacgcgtggcttgaaagtaaactttattgcgtgttagtacctgtccattcacaggggtatccagcccttgcgccgcctcccccagcccgccagccaccccagacaggagatgataatgatgaggagcaccggagccaccacagcacaagtgattaggagcagggcccagtgcacccaggtggtcttagggcgccagggatcgattggaaaagggcccagggtcactggcttatgcgtgggacgtttagaaacaggccgcctatggggcctgtgactggtgcttgtggtgtgggagactaatgtggtgggggctatggtagtggctgggataacagtaagatgcatacgctgagtgagggtccggttggcatggtattggtcgtcttcttcccctgcagagtaattgcagtggaccccggaggccacactgcaatttctcagtgtcacattgcacgtgtagtaacctgcatgcgcaagggtcacattggggattatcagagagacggaggtgttggagtcatttacccattctagggtaaggctataattgtaacccccgttagttatatgagttccgttgttggaagtagctacggccaagggcagttgtccatccccgggagtgtatccccggcccaactcgatccgagagaccgactcattgctaggaacgctgcaggtgagattcactctagcacctgcatgggcggtgacattttcaaatttaaccagatctgagaaaaatgcacaaacagaccccacacagcagcacaatagaagcactaaatgagtcattcctaaactgtcagttttaaaactccctgcttctcaggcctaaatatgtggtggggtgtgcttaggatcactttcatattctgcaacaacagccatacccggaagaggagctgccggttgccatttttcaagctgctaaaccacgagtggcagcaggcctaagaagctcctcagcaacatggagacctcgaagggaaactggcaggagcagggagtcacgtaggcactagcctcttcatgtgaggtaagagatcgctaaaaatgggatcagggtatgtaaaccgagttttgcgggggatggtgagccagacacggcgggtgggggaaggagctgacacgattgagtagaaagggccaaaaatacaccagctataaggaattgctcaggccaaagttgttcctcaggtggctttaggcctaatgtaggcaattgcgtgcctagaacattgctaatgtgccctgggtttcctgccttcatgcaaatattctacctcccccggcctggtgcaaaatgtctgcctcagaatactaacagctaatccaagctaacattctatcagtaaacgggcagaaaactgataaggaccgcggagtttggccctccgcggtgtccggtggtcctcacacgtgccctccccccgggccgatggctgaggcccggaatatgcaagtgcatctttctaaccagtaggggcctccacctaggtgctttgttaatctttagtgggaactagtgggagtgctgtgcctcgggtacccctatcctataggtcctaccggagctccttgtcttgataatccctgtaaacacacaccacctaagaacaaggcattgttaacctttggtggaacctagtgttagtgttgtgctgtaaataagtgtccagcgcaccactagtcaccaggtgtcaccggaggctacttgcctcagtgccacttttaccttctcaaatctatacggggggggggggggctctgtaacatttggtgggacctgatgctgctggtgtgctgtaaataagtgcctagcacatcacgtaggcaccaggtgtcaccagggctacttgcctcggcatctcctcaccggagaaggggttaacaaacccgtggggggtcttagtggaagtgacgtgctgtgaatacaggtccatagcaccgctatccactatgtctcgcccgggctatatgtcgccttacctcccctatatagtcacgaccccaccgaaccaggcatgatgtagaataaaattttatgcatcatcttctaatctgtgccgcttggagggaaacatgaccacctgaagtctgttaaccaggtcagtggttttgtttccttgatagagacacaaggactgccagccccattggggagggggggtgggtacgggagagtttgggctcgtttaaacaaagtctcatctgatgctctgtggcacctcaaggtgaatatagctgcccatcgacgtatcgctggaaaccggtgggccgctgttcacctaaagtgacgcaaggtctgtcagccgccagggtccgtttaccaggctttcaggtgtggaatttagatagagtgggtgtgtgctcttgtttaattacaccaagatcaccaccctctatccatatcccacaattgataaacctccgcatgtccaaccaccacgttgaacaggatgtggcaccctaagaggacgcaggcatacaaggttattacccagtccttgtatgcctggtgtccccttagtgggacgcaggcctaggtagcatcatttacactaaaagcagtgaccttgttggtactttaaggttggtccaatccataggctttttttgtgaaaacccggggatcggactagccttagagtaactcaaggccaagcatttcacacctgcaaatgcaccatgtaaccacagatctaaactgaaagttgcagctttagatggcaaggaaacttgggtttcaggcatagaaagcctggctcactatagcagcccatgtttgttccagggtgggggaaaggcacgtgcccttagaaaacttagctgcaaaaattctattgtgttgggagagcctctatatctaaaggcctttcctcacaatacaaatgttactaacgtctgccctctggagacctgctatgtggctagacgtatggcctacccaagacgttgggggtctcgggtaggccatgattcttccaggcataggttacaaccagtcactgctatcaagcctactcagttcccaacgcagcacataccccccgcctctcctgccatgaggacttatggcagtgtttactgttctgcttttactcttggaccaggctgtcattctatcagaataacaggggaagcaaggccccctgcttcagcgggacacgtgtttctagaatctcggagccaataactacctgcccctctaatctgtatgctgcatgaaaaaccacatacacgtgatgtaagtttagccagtttattgttacaccaatgccccgaaagtctccccctgtccctttgggtctcaggacccagccctggagctcgggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggatgggggtgcgctcccaggccggaccctggtgccaggcagggaccccgcgccacccgcttcatggggggggaggccgccgcaaggacgccgggccggctgggaggtgtgcaccccccgagcgtctggacgacgctggcgagccgggccagctcgccttcttttatcctctttttggggtctctgtgcaataccttaaggtttgctcaggagtggggggcttctcattggttaattcaggtgtgtgattttagcccgttgggttacattaaggtgtgtaaccaggtgggtggtacctggaggtcattctattgggataacgagaggaggaggggctagaggcccgcgagatttggggtaggcggagcctcaggagggtcccctccatagggttgaaccaggagggggaggatcgggctccgccccgatatacctagtgggtggagcctagaggtaggtatccatagggttccattatcctggaggtatcctaagctccgcccctatataccaggtgggtggagctaggtaggattcagctaggttcctactggggtacccccctaccctaccttaaggtgcgccacccttcctccttccgttttaatggtagaataacctataggttattaacctagtggtggaatagggtattgcagctgggtatatacctataggtatatagaacctagaggaagggaaccctatagtgtaatccctcccccccctacccccccctcccttacggttgcctgagcccatcccccaccccagcaccccggggtgacgtggcaccccgcgtgccttactgacttgtcacctttgcacatttggtcagctgaccgatgctcgccacttcctgggtcatgacctggcctgtgccttgtcccatggacaatgtccctccagcgtggtggctgcctttgggatgcatcactttgagccactaagcccccgttgctcgccttgcctgcctcaccatgacacactaagcccctgctaatccatgagccccgcctttaggaagcaccacgtcccggggacggaagctggattttggccagtcttcaattttggggagtggttttgtgtgagccggaagttggcaatggggtgagggtggcgctggttaagctgacgacctcccaaggtctctcaccctgggtacacaggtggggcggcagcctctaactttggctgtggcctctatttcctccctttcctagccagggccatgtgttcctgcatgtctacttgcctcctgtggtggcagagcttggccctgggcccaacccccgccttgggagcctgtaggggccaacacccttggtttgtttgtgttcctgtttgctggcaacttactggcagccgagcagattctaatgggcgcccgccttctttctctcttgttttattaatagaatctcagccaggacctatacctgagacttcaaagtctggtcctgggttctgagacccccaagatttgtcatgcacacctgcacacctgttggtattgggtttctattcttgagtgtgaaagtttgtaaaaaaattcataaaatgtcactaattcctcttacctgtttagggtattgtgcaattcttcagcctgcctattttcaatttgcctaaggtggcaatttaagatgtggttaattaaccattttcctgtctgacaccactgcatgggcaaccgggttccatggcacatttagagataaacatagatgtcttgtcttgctcatgtgcagaggagggggtgttggtgtgcaatatagtttctggattccaaattgagttgggggtgctattttcactatggaattaaattactgacattagacagtggacaccgggctatatgtggggatgtctgtggcttgtcatttcctcttagaaggtaatcccccatcttaacttccctttaaattgtgatgcaagccctgggttatttatagaatgattatctaggtttgatagtctgaaggctgggcagagaatgtttgtaatttttattcaccttctttaccccccacgagtatccagttctagaagatctcctgatatcccgggctgccattattcccttgagtgttatagcttcctcttaacttaagcaagagctccaggatgttagcttttttggtggggctggttgtcaggaagaggttccagtgttgtcctttatttttagatgttagctttgtgttaggttagtatgggctgggtattcactagtgaaggcaactaacacagttagacgtgctagttgtgcccactggtgtttatccggtcccaaatgtcaccacagaacacagggggctggatttggcagcagcacttgtgcttttgttgatttttacccgtgtatcagagtgggggatgctagccaatttagcttcccctccccttaacagggggtctcgcggggtgccaattgtcgcctgccttcccccgcttccccttgttaacttatagcatgataggtaggtcacctaacgtggaagcctggtgggtgatccttcctcggtagggagcgcttagggctgttgagctcaacagccccacctgggtaaaatgtatgttctaaagagttacccaattataacaaaactgttgtagggtaacgaagacctgatggaagtggtattgttgccgttgaaagacgggtgtcctggctcaagttcgcacttcctatacagtgttaaagccttgtatcggaagtttgggcttcgtcccagtgtactcgataatgtcgactgctgcgaaaggtttggaccgtcttccagtaggtgttgggggtcccaaatcacgaggttaggcaggtgcacttggctctttaggagggacccttaagccagacaatgtagtgccccttttttttgcaaattggccttattattaatttcttgttaacactaattctgttctatgaccctgtgtttttcagatgccgttgaacgtgtcactgagctgaatttggacgcagctacttgacctttgcccccgtgcctccagcgctgataagtgctgcgtccactttgtgttacaggtgggccaaacctccagaatatcaattggtggggccttggtgggctgcataaggcagtaggtttgaggtgacctacttggaccatgtggatccagtgtcctgatcctggaccttgactatgaaacaattctaaaaaaatgcatcatagtccagtgtccagggacagtgcactcggaagtctcatcatctccgtttgtgtgtttagtgtggccagtacggccacccctgtgccacgccctggcatgctgctgacatctggccgccaatttcagcgggcccttttcccccttgttcaccccatagcaagaagggtaggttacatgggtattttcccatcagcacctgactggccggtgcaattagaggagagggcaacaacgcaaggctgttgttttatttgggttacaagagctgcggcggtcgatgggttcactgattacggtttcctagattgtacagatgaactagaactgtcacaatctatggggtcgtagacagtgtgcttaccagacttccatggaagatgtgaatttgctgctagctatatgggtggtgctatgggctccctagggactcatgtagtggggctttgtgatagctaatgaatgtggcagctgttgtttgtactggaccctgaattggaaacagtaacttggattctgtaacacttcatgggtcccgtagtgacaactatgctgaatatcttgaatatgggaggaggggggctttgggttccattgtgtgccctttcctggccaacgtgagggtcctagtgttatagggcgtggcagttttcttgagggctaataacccgggtgaggcggttgtcacaggtgctagaccctggagttgaaccagtaccactcggttacaaagtcatggtctagtagttgtgaccctgcaaagctacgtggggatgagcagccagggactttggttggcaagcagacaggcggcgcattggaaccccagaggagtgtcccggggccacctctttggttctgtacatattttgttattgtacataaccatggagttggctgtggtgcactccatctggtaagggggctggtgcggacgcctgtgtttagtctatgccaatgtttacctgccttgggttactattccaaacgaccacacctttgaggacacctggagccctgatcattctcggcttttactgccacctggcttctgttgggtcagacagtttggtgcgctagttgtgtgcttagcagcaacgcacaccaggctgactgccttagcagtgtggccctttattgtggcatcctaaggagggattctggagtgcctttcgcgtgaagcatgccctgagacgtactcgagttaggacttaatcgctcctgtgccgctggatgagggagcgccaatttgtacatcctagctctggccatagagttagcccacccttgtgtctccctttggcctttgcggtgccaatttccggtggtttcccttttccgcccgtttatccaatagcatgtaagagaggttgcctagatttggcaactttgagggaacgttccgtgtagctggtgacctaacacccgcccatcaccaccggacagattctgaacttgtcctgtggtgtttggtgtggttttggggtacgcaggagtacgttggaatgctttggagccgagagggatgggcccgcttgtgcgcttatgtgttacacggtgccaataaccggcccggtgcggctgccccgtgacccgtgggccttaccttcctggccatcgggggaccctggtgctagggtcccttgtgttgctttctgccataggggggaaagcatcgccttcagaattggctgctccgttggaacatttgaggcctactgtatccgtgtcctgacaacattccccgcaaacatgacatgggttaatttaaacatgttttgtttgcttgggaatgctcttagggcctggaagcttgtcattggattcatcgtttcctgaactacaggcgtagggcctattgtagcaggcatgtcttcattcctgcgtaccgaatggcatgaaggcacagcctgttaccattggcaccttttttccatgtaaacctccgtgatcctgggtcctttggagactcaagtgtgaatttgttttggtgttcggcgccagggtatctcgacgttggaatgtcaactcaacttgggcacctcgataaccggctcgtggctcgtacagacgattgtttggctctgtaacttgccagggacggctgacgatgtgtttagtctgccacttgcatccggcgctttggttactcgggagactaatggggggtgtggtatggcacaggctgggggtgagtctggggatgtccctgggcgttgctgcagcccattcgccctctggggatgagatgttcaggggtggccggtaccctacgctgccgatttacataatataaattgtaaatgctgcagtagtagggatctggacgcgcgacctgctactcttcggaaacgccaacccaggagcgtcgcctctggccccatactcccgccatgcgactgctcgccccctcccaggcctccctggtgagcccttgccgctccccgcattcctgctttcggcgcccctgcggatcccgatgacagcaggcctttccttcccccgttaatgaaaagaatgacagtgaggttgtgacagaaggacagctttattcagtttacagagtgccctcggaggctacgatattcccgttaaatgtcttgttgattctctcaaaggtggggagggaggagctctccacaacaatgttccctggcagcgtgagcgcgcagccctgccgttggatgtatcttctcatgatggtgctgatagaggggtctccggcgtagatgaaaaaggcctgggccatgctctggccggtcacgatcgttatggggttgttggaaatgttccggaccgtcagcttgagggtctggcccggcttccactcctgtgggtagacgtagaagaccgggttggaggagtgggacacgacaacggccgtaatcttggagctcaggggggcctcgtaggtgttgttgtattccagctccgtgatgaaattaggaggaataatcacaggggagccaaagtagcggatgtctgtggattccccgtcccagcgccagtggctcttagggtaggggttgtaacggaaggcaataatcacatcatccaatagggtcatgcccaccttgacgttcagcgggccctctcgtttcaggtccggcgtgtccacggagactcggacgtagcccttaccgcggcgtatggcgtttaccggacacaccttccccgggaatgtgtgaatacgggcgtatgactttagaaatgggggcgtgtgctgcgccagcaggtaaggcaggcactcgtcctggctggtgacgggagagccactgaggaagatctggggctcgctggtgtttagcttgtccccgctctgggtgcaggagcgtgtcagctgaatgtcgctctgcccgggcagaatctgcaggtagaggtaggggttcttgaccaatctgatgggcacaatgtaccaggtaaacttccctttctctatgaacaggctgcgcggattcaggacgcttagcacgatgtcctggtcagagtgcataacgaagaagggcttgaggaatacctcgttgtcttccgctccaaagaacaaaaacgcgaccgtaaagtagcggctgccgtaggtggtcgtgttgaaggagaaagaaggtaacttgaagctgagtatctggcccaccgaggggcagggaggcagctcttggcactgcgcgtccagctgcaatacctgcttgttggtgacgcggacgtatgaggggaagatctcgtacttccacacgcctctcatgaacgacgtgtctggtttttcagtgggccgcaggcggcggaggctgttcctgaacgacgagcgccgggacgctagtgctgcatgggctcctccggggtaagcttcggccatggccggagctcgtcgacgggcaaggtgagagtcggggggcgggcgacggtgcggccccaatacaactctccgctcgttagctggtagaatatccgcccggcgtctaggttgtcacttcgctcggccggccagaagagcgcaagtccaagtctggtgctggggccgatgtgcagcggtttgtgcccgcagttgtagactgtcatttttatgggcgagtgggcggtccacacgcgcgggcgcagcacccattggtcgcacgccgcctcctggaatgtaaacccccagagagagggcgtgccgccctggagatggccctgtgccatcacatgtatttcctccttgggtggaacaacggcgtcgtgctccgggtggagggggaatagcgtccaggcatctttcagggtcacgagaccggggtccatgctcagagaacagccctcccgggcggtgggcggcccgggctccagcagaacgtcgcagacccagccctcctcggccctgtccacctgtatgtccaggtgcacggacccggaggctgcgtctcgtgacatggccaggcctggtgccagccgaccacgtcccgtgtcccagccgaggccgcgccagagcagagcccgggactgactcagggccacatcccctcggcccgcggacgccgcctcgccagcccccgggccttcatgggcccgctttctacctctctccggcaccccagcctggtcagccgcagaggaagcatgaccttggggtgggacggggcaggcgtgatcctgggcgcaatctttgccgatccccacaccttcactccttgttaggttgatagaatgtcggtaccacgccacggggggcgggcccgcatagggaaaagccagggagagcgatgtgggcgaggatgggctcaggcggccccagacacgcaatttgcccccctgggcggccgcagcctgcccctcggcggcccgtgccccagctccgtcacggggggcgcataggaggggtatatctaggatagccgcacctacacaaatgagacacagacacaggtcgtgaggatttaggcaacgcaggcttgtctttatagttacaaacatgggagcgtgcacctggaagatgcagctggggtagatctttacatctttacagggcgcagcggccgccagacactgaagggcagagttcacggcgggcacctcccagagggagcccaccagcccgtacctggccacggccagggcctcgtaggccgagacgggcagccggagcttgtggtactgtccctccggcaggtggagtgggacacagttagagaacattagtcctctggtccctatctccacccgccaggcctgtgtgtcagtttgcagggccatcctcgcactcaggtggactggctaggcacccttctgaagtatctggcggtgactgtcacctggttcttgagagagtccataaaatggctgaagctccaggcgtatagtataatgagcaacagggccaaacaggcggcggggcctgggtagtagcgggcaacgagagactctgtgcaatcaaaccccaggctcccggcctcacccaggaagagcagcggcagggacagcataaaccaggagaaggcgcaaatgagtccggtgaaggtgacgttgcatatcaggcgcggcttccttccgaattttgtgcgcaaaagtttccagatgatgataactgtgaggaggacgatcaggactgccgccagtaggtagcagccggctttcagtccttggacggccgtgtgcatgcctttggtggggccttccctgcacatgttggggcctctgttgagattggcgtcggggcccatggtaatgaggaggatgataatcagcaggagtaccagacaaaacacgcccatcaggtacaggcacacatttctgtgggaggttctcttgggcgttcggctgaacaatgctagggtcttctccaacgccatacccaagtgagtccatacggagcacatcaggcccaagaacatcatgttctgggtcaaaaggcagagaccggtagacgagaactcctgaatcatttttcccagcacccagagcagcagttctatgagaagagctatcagccagacatccattcggtgaaccaattttcttacaaagatgataaacaagatgccagccagtgttagcagaatcagcaggacgagcagcaggcttgtcatgccgctgaggaaggcgctgtaggatttagtgcacgcatcttccgttgcattgacggaagtcatgttggccaccagggtccccacggtggacccgggggccatggtggagagcatcttgctggtcagagccagactgggtggtgtctgcagcaaaagaggaacttgcccaggcagtcagttattttgcatgccacctccctgcctggtggacttccagactattttctgcattcgcccttgcgtgtccattgttgcaaggagcgatttggagaaaataaactgtgagtttcacagatccacgggccacgctcccctgggggcttcatgatcccaccgcctttcccgatgatgatgacaaccgcggctgtctgaagcggctgacgaaatcggttgagattctgatgagaggcttgggggggtctttgccctcaaggcgaggctccttctcctaggaatgccgagccccctgcactagcttcgctccactggggatctttgccagccttcatactagattcagcgatcccccggttgggaatcttcgccagccccccgtcctgctatcccgctcgtcgccgcgcctcccatgctaagggcccccttcctttcccttgactttggggatattcggagtctgctctcgccgctctcttctctcgtttaaacgagagaatagtagtagggtccagtctcaggccccctcactttgggtcttagaatggtggccgggctgtaaaattctggaggacggagagggcggccccggagttgttatcaaagaggcactggaggatgttggccgctccttggagcagcttgtcgaaataatgatccacggccacgggaacgccgtgccgctcggcgtaggccgggtcctcggccatctccgtctttctcgcccccttcactccccccttgggctccacaaagacgtactggatgcggtcgtggatctggggcagttcctcgttgcgctcgacgaacttctggtagacggccaggtgaggcatctgggtgctcttgtaggctgagagcttgcggctgagctccgttgaaaagcagagctcccccatggggaccctgccttcacggaggtctgtgtaggcctggtttaggatgtcaatgacgggcaaaaagcccacaggtagcccttgtgtaaatgactcttggaagggccggtgggagaggaggctggccgcctcctttacccgggcatccgccagcaccaggtcgagcacgcgccggcagcgtgtctgcacaaacttgcaggccgtcttccggacgagctccacccccttcatcagggtcttgccgtccgtcagcacccccacatatctcttctttgtaatcagcatcaggcaggagaaggtcttctcggcctccagggagatgggggccacaaacaggctccgggtggtgtgggcggccagggcatcggcaaagcgcagggtctcgctctctgaaaacccccggcactcgataaacagcgagtccgtgtccccgtagatgactcgaagctggccctcggggttgaggggcgcccaggcgtccggggagggggccagggcctgcaggttggcggggctcagggcctccacgaaggccttggcccgctccaacatcgtgcggccctgcagcgtcaccgtctcggcgatggagaggcagggaaagaggccgttggccaccccggtgaagccgtagacggcgttgcacgtgcacttgatggccagctgctgcttgtcgaggatggtcctttggcgcggatcctcgcaggccgccagcagcttcttgatggccttgcgcttggccagccaggaggtcaacagactagccaagaaggactcgtgcacgtgcttctttacaaagtggtagacgccccccgtgagcctgaaggactcatagtcttctcccgggcgcaggccggctagcctgtgctcttctcccggcgttatcatggtagaataacagagattatgagcctgaatgatgctcgggtagaggctggcaaagtccaccaccagaaccggggagttgtagaatccggacaggggctggatgacggtggccccctggtagccgtcccggtcagaggccgagggcatgggcaggataaagttttccttttgggcggccgccaggaggcaggagaacacgcggatctgctgcccatcgtccagcacccgcctgcaggggatgtgagcgatcttggcaatctctgccacctccacgtggatcacgaaatggtttagcagatccatgaccagggccgagtcctgcacgcagtacatgccgagccgcctgcgcccctcggggcccgctgcaaagaggcgaggaatctccttgtaatgcacatcctccttcttggcccccagtaggtgcctggctactgtgtccagcttgtagtctgagaggctgagcttgtcccggcacacggcgtacatgtcgatggggatgaggccggtgatgcggaccttggtgttggcccgcaagaagcccttgcccgcatcatggggtcgcctgacctcgcagacgcccccagccctaattttgcccagagaggctgggttgatgctgtagatgtgcctggctctgtccagaatgtagggccagtcaaagttggccacgttgtagccggtcacaatctccacgctgaggtctctgatgagctggaagaaggcgtagagcatgtccagctccgatgggaactcgtagacctcaaccccctctatgtcttcgcaggtgcccagcgtcagcaggatgcgcctatagcgcccggcctcctcccctgtcgaccagaggacgcaggatatctgcaggatcaggtcagcctcgttggtggccgtggggaagccctcctcccccagacactcgatatcgaaggccagggcctggtaggagggccaggagctgtcttcacgccggaccgagaggtcgcccacctcacagtcgtactcgagctcggcgtacgagtcccggtgctggaggcgggggatggcgcggcggcagctgtaccagccaaaggtgacaaagtcattgtccaggacaaagcggcgcgtggcatccacgttggcctcaaagatccgacacccgtgcttgtcttgcagccacgtggccacgtgacacacactgttgggatgggagagggtgatcttgtggtagtcgccggcatggttgccgtagcccataatggaacggcgcgtgaccttctccaccgagacccggcagggggtcctgcggtcgaaggtgctggccttgagggcgctgaggactgcaaactccacgtccagaccctgaggcgcgctggcgtagaagtaggcctgctgcccaaacacgttcacacacacgctggccccatcggccttgcgccggcccagtagcttgatgacgatgccacatggcaccacatacccctgtttatccgatggaatgacggcgcatttctcgtgcgtgtacaccgtctcgagtatgtcgtagacatggaagtccagagggcttccgtgggtgtctgcctccggccttgccgtgccctcttgggcacgctggcgccaccacatgccctttccatcctcgtcaccccccaccaccgtcagggagtcttggtagaagcacagggggggctgaggcccccgcacatccaccacccctgcggcgcctggtgtctggaaacacttgggaatgagacgcaggtactccttgtcaggctttttcagaaggcctttattaggtcttaggaaagggttatagaagagtcccccagacatggttaaaactcagtctctgcctccccaagcagtgcggcggcggtctctggatcgtgatagcgtcttctgcgtaggcctggaaaacggtccctggctgcctgcaatgctctgctggccactgagggtccggccgccctctgagctgctctcttttgctcctggttttgctcatgcagcgctaacatgatggcttgtaattctgtcttactaatgggattaatgcctggaccctcaccagaggcatgttgctgagcgagctcgtcgatcccggggtagagcatctgcaccggctgctgcgacatctggcgcgtgcgcctcgtgagggaaataaccaggatcaccacccccgccaccaggaccagaatgagcatgccgccgaaggggtttttgaagaaggagatgaaaccagagaccaggctgctaaacaaaccccccaccgtgctgactaggttggtgatggactgacccacgctacccagactgtccataagttcccccaggccgtccacgaattgatttcttccgtttgacactgcattgtccaaatccttccgcaggccggcgatgttttgcgcctggaagttgtactcccggaagatgccctccaggtcaaagacgttggaggcacgctgttcgtcccgtgagtacagctccagggaggcaaagtcaatgttctcgatgagggaggtgtttagtgagatgaaggtctgcagggtggcaatgccgtccagctcgatggttttaaagtggtggtagtcgttgtagacgtggatctcgttgccggactggaagtagtactggctggtcgcctggcacacctccgtcatcttttttgtgaggaagatctcgttgtcggtgcccagctgtccctcgtaggtcttggtgtcgttgataaagctgaaggacaccagggggcgcgagtagcacatggtctcggagccagggaccctcatgctcttgcgcagggtgacggtggcctggttaacgggcacgcactgggagactgagatgacatcccccaggcgcttggccgccaccgccttaccgtagatgctggacatgacggtggttggattaatcttggttagttctctcagcaccatgttctgcctcttctgctccaggcaccaggcccgcgcaaggtctcccagcatgcggttgatctggcggcgcagggagtcgtaggcaaattggatctggacggtggcgggattgttgagggtgcccagggacttcccgggggccgtggggggcaccggtgtggtggcgttccccgcatcccgcctccgacgcctcagaacggcggcgggggtgctcccgcgggccgcggatggggctgggggcgatggactgctggggggtgaggaagtcggagtggtaagctccgtcaggttcttgacggtggccaacgagcgcggggtcagaggtagccaagctaataacaatcctccgctcgttataaaatatgtaatggcttcctggcccttcgtgtaacgatcctggacggcctcgtacttctcatgcatggtcttgttcacctgctcttcgatgcacttgaaggcgtccgggagctctatgcccacggttgtgttggtcacgaagctagaggtgccctcgtcagtcacaaaatgtattgacttccctgtttctgtggcgatggtcgagtcaaaggtttgccagtgttgaagcgggcagtaggctgtcctgttctcgagcttccaagatagcgtgtaagtgcccttgtccaggaaggctcggcgttcgccttgcgggttcgtccctcggttgtcgtagtccactatcttgtagttagttctcacgtggaaggagtctgcccgctcatggaaggtttccttatttttcccgtcatagaaaggggacatttccacagtctgcccggtggtggtcacaaagaagtcgaaggggctgttggacttggccatcatgtcagttatcaggcagttgacggtagttcttgttctgtaagtccatatcaaccacccgggggcgtcatagagctccgtctggctggcgtagcggcgcaccccgttggccaggcccccggtgggctttaggttgacggtgatgttaactccgtcgcggtctacatacacgcgcgtcagcccatcttttgtcatcttgaccgcgttgtagcactggtagatggtatccatctggtcagtttcgtagctgtcaacggagaacttctcctcgtgccggttggtcacggagtccgcgtaccagccattgtagatgagaatgttggtcactatcttggtgtaggagcggaccttaaacgagtagggaataatgttgtctttaaacaccatcaacaggccctccgtgtgattctcccgcgtgccaaacgagggacactggatgtccgaggagaagcggaacaggtcgccgtggctggagagctcgcagactcggaaaggaaagctggtttgctgacgcgtggcggtaggctgcaccgtggtggcggggggtgcgggctgctctggggtctgcgcaccgagacggcacgccagggcggctagcagcacgaccacgcttagcaccctacgccgagtcatctctcatttggaggtgcaggtagagaagggcatatagatccttaaatacccaccccctgcccttatacagaagaattagggggcggtcagagtcgtacgtgaggtaaagcccatccgggggcagggcctggccggggctgaccgcgtccgcccggcgcaggatcaaggaccgcccccaggtcttgttgtagagggacacggttaggacggcctcgcgcagcgcccggcacagaatttgctggctagatgccagtgagcccccgggtacgctgtagaagctgttgaaggaggtctctatccagtcgctcggctcgatgcctggccatatcagggaagtcaggaatgccttctggtggggcagcgtacctgcggcgtcacagcagcgagccagggccacgttgctgggtgggggaaagagcccgctctcctccgccaggggccccgtgatgaaggtgtacaggctgtgcgtcagcgcgtgcaggtgctccgagctcagggtctgggtaaacaggtgtgttttgatgtacttggaattctcaaaggcggcaccctcgccggcgcgcctgtcctcccagggacccgagacgaaggcccgtctgtagaggaagtggttgcgcatgcgggccagctcccagtagaccacgtccccccagacgcgcaggcacagggtctcggtcagggtctcgctctgttgcgccaggcaggactgcagcttggccagaccctcggtggccacctggcgcaggtactgctccttgcgcttgagcgcgtccgagagggcgccggacgggccgggctctcgtgccccagccggccggggcacctccgggctctcccgggacgcctcctcctcgcctcggcccaaccgctgcatggctcggttgagccgcgtgtacagctcgttcctcttttgcaggatggcccggtactgggggtgcgccgtgaaggcggcggcgcagtccgccttcagcgcctccaccgcgtcgcccgaggagctgtagaccccgccgcagaagagccgctccgtggccccgggagccacggcgtcaaacaggtgagtcagccttgcccccgccagcgcctcctcgcaggccccccgcaccagggccaggcgacgctcccgggcaaacagggcagagaggcgggaatggccgccaccctccccctgccccgttgcaccgatagcatggccgccagagttccaatagaggagctccgagagctccgccacctccgggggcactgtcgagaagacgttgtaggtgtccagcgctctggtcgccccctctgcctccggccgccccgggcccgggaccgcgccctcctctgggccgcccggcctcgccttctcctcagcctccaacaggtgcccgagccccgcctggcggacttcattctcaaacagtcccgagaccggctccggattcaccggcaccgccaggtggttacaggagacgtgggtcccctctgccgtggaagggttgccgtggttgggcagaaccatcagctcgcccacacagcgccagcagggcacagaggtgatgtagaggcgcgggtctgggatgggacttacgccccgaaagcggcccagcagatccagggcccgttccaggctctccagccccatggtgtgagacatgcaataaaacacgctattgattctcttcattaaaatctctatgtcatttattaggcacaaacttacatcgactttatgccccccgtaaaactccacagagtacgcgactgagggggtacggagaggcgggacccgggtaccctttctaccaggggcgagcagcgcggcagaggcctctctcgagttctctagcaggtgcaccagctccagggacagggcgctgcatgcacggtcattctgccgtctcaaacggggaaggaggatggcctccagctcggccagcaggccggcgttgcgcaccaccgcagccacgtccagactccgggggtccagccgggtgcacacgctcagctcaaccgccagggcgtacacctggctgtacgccgccgccagcagccccgacatcgccgccccaggggtctctagacctcgagtccggggagaacggtggccagacggcgcttgcgtctgcccccggagccctgccctcctccacccagcagcagcccggccgaggcctgcgacgcggtgctgaccggctcggccacgctgataaagttgtcctgggctgccccgggcccaccccacactccctccagaaagtcccgagcggcctccgccgtccactctatcccgctggaggcaatggtcgccagggtttctaggacgctgtccgccaggacggagaagcggcccaataagtactccgcgtcgtccctagtcagcgaggcgcatgcctcgcccatggcatccacaaggttgcacaccacatcaaacacacagtcttcctcctgtttttgtgatataatggcctccaggccagccctgatgttctcaatctcatatgtggtcgcggcttgggtccggcgcttcacggtcaaccctagggtgggggtggcaaagacaaacttcttccgcatggaagagcccccggcctgcttgcgcagcccagccccgggggcctgcagcaggttcctgtccacgccccggcccataaagtatcccaggttcccggcctggaatatctggttgttgccgttgacccccgtgtacttgttgatggtcactggcagcgtgacaaccggacgggccttgcagacctggctaagacagtctgtggccgcgcagaccaccgtggtcgcagtaagggaggaggtggcctccgcgtaggccgctgccgactccaccgcccgcgtgcccagtacgtgggggtagtcacgggcgggcaccgactgcgtcctcggcaccagtccctgaatcaggctgatgtagaactgggtctggccgcacgccttcaggatggcgttgttgagcctctgcttggcgtaagtgaccaggttgccaggcaccacatctatgacgttgctctcttcgtgggcccgggagcccccgtccacaaagagggccaggtcagagtactcctccgcgctggccccgctggggacagggaccgagcgccgcctggaaaagttgtgccacaggtacaggcttgagagcttagtgtccgggaatagggtcttgtggtaggtgttgaggaatttcatgtagggcccgttgatgatgtagttctccctcctggtagtggacttgatgaagctgttctggagggcggcattctcccccgtgaagaccaccctgttcttgatcttgatgttcctggggcacagcatcagcaccttggacatgcgcacaggcagccgccggccgtacacccggccctgcagggccgcgtccaggtctggcaggtcgcaggtgggctccccatgcaccaccttggcctccttggccgtgaggacccccttgtcgatggccaggctcctaaagttggtgcacagcgtctggtagtgaccctttagccactctggggggctctggccaagcccggggttgtcattctcatagcacatacagatgggcagggagatgtcctgcaggatggtcagcagtgagcggtaaaacagctgggtgaagatggggcaggcgggctgcgcaaaggggttgcacgagtactgcatcacgtggtagcagctcttgaccaggtccttgtaggtgatgttgttcttggccatgctgttcataaactggaccacttcggcgtccaccgccgcatccacgtccttgaacatcttgacaaagtcacgcgggccatggggctccttctctagctttccttcagcgtctatgcccagccgagacagccgctccagcaggttctggttcagctgccagtaggtgtagcggggctcgtcgtccggccgctgcccgtcgtcctccttatcgatgaagttgagaaagttgcccaaaaagtccgtctcgttgtaggagcccgaggcccccgagatcacataggggtccctccgctgcgtggacatgacgggggggaagcggtccctcagcctaaagaagagcgtgttcaggcacacggccggggcccggccctcgcagagcgagcacatgggactggcggccgcccccgccacgtagctgcccgtctccggcaccggggtcagagagctcttctgtccctggcaaaactgcaggtagtaggcatagcgggcaagaaggttgggcgagaaggaggccgcatagaccaggtgctccacagcgtagtttcccggaccgttggttccggtcacgtctggcccaccccagcccgagaagcagggtcggcggcaggggtcccaggtcccctcctgcagggtccccaggccgtgggtcatgtagaaactgttaaagagactctccttgccctgaccggttgacttcgagacccccgagacgtagaggacggaattggtggcaaagatctgcgtggacacgtggggggccaggctggcattatatcggtgtaacgcagccacacgggcctctggaccctcacagtcggcaaacaggggccacgagtcgtagttgaggctggccggggtctcgtgcgaggcctccagcatggcgggtgcgtagctcaccgccagctcgcatgccgcgctgtccacaatcattaaggctcccgagtccgggtgactgatggttgaggctgggaactccttgaggggggccaccttggccaccttggcctggtcctgcaggctctgcttctccagcagctccaccagcttgcccacccgtcggacgcgcagcgcctgcgccagcccggtgtacagcgcctcgtgcatgcagcggctgaggtccgagttgtaaaactggcggagctggggcacgccctctgggaacacctccttgtcgtagagcgggaccctaacgctcgcagactgccccaccgctacctcctgttttaacgatggaatggccaccaggtttccgctgtagagtcgctccttgaaggcctcggttattgccaccgcccccaggtaggcagagggatctagcccttcggggaagaagtcccccggcttggagctttccctcggtagggcgctgtaggcgtcgtacccaaacacctccctggtctcgccacagagggcctcgagacccggcccctcaaagatggggggaaccatatgggcattgtggaacacgtagatgtccctgtgataggaggtagcgcgtaggagcccgcagttggggtcgggcctcctgtgcagagccttgacattgatgctgaagcccggctccacggtgatgccgcaaaggagcggcaccgtcaggcacctgtggcccgcgtagccggtccccagtgtggccacctccctaagagggtaggtggccagggggtaaaagtagatgtagccgcacggacccggctggctctggctgcccagattatcctcgctagtctgtgcaccctgcatgatgcccaaggtatcgccccggcctcccagtcccacattaaatgttacactttactcatcacgcaacacccactgtttattcatttacaaagatttcaggaagtcagtcaggctggccagggcccacgtcacggggaactgacgtctcagcgatcttggcatgccgcccagcctcgcaaaccagagtctgcgatagagggccaggtagtgggcgattgcccccagcacgaaggcggcgctcttgtggtcatccaggtagtttcgcaccgcaaacaccactgtgtagcacagcaccaccctgagccgcgaccagtagtcgtagtggtcgttgtacactgcgcgcaggacgctgatgatgagccgtacgtgcgtgtctttgcccccgatgtcggctgtcctgcaggccagctccgcgtacagcttcctatccttcctcagggaggccttgatgagccggcagaggaccagggctggcaaaggcaggtctttctcatcccgggtgaacaccgcgtacatggccctgaacatgaggtagctggactcagccaccttgtcgtccggcggcgagggcgcgacccacgcctcgaccggggtcctcacaaacacagaatctgtagacttggctggcctcatggtctcgtcaggccagctcacgggcttcaggcttatatgataaaatgggcgtggcagaatagtataagacgcgaggcctgggtgaggagagtccagagcaatggccaggttcatcgctcagctcctcctgttggcctcctgtgtggccgccggccaggctgtcaccgctttcttgggtgagcgagtcaccctgacctcctactggaggagggtgagcctcggtccagagattgaggtcagctggtttaaactgggcccaggagaggagcaggtgcttattgggcgcatgcaccacgatgtcatctttatagagtggcctttcaggggcttctttgatatccacagaagtgccaacaccttctttttagtagtcaccgctgccaacatctcccatgacggcaactacctgtgccgcatgaaactgggcgagaccgaggtcaccaagcaggaacacctgagcgtggtgaagcctctaacgctgtctgtccactccgaaaggtctcagttcccagacttctctgtccttactgtgacatgcaccgtgaatgcatttccccatccccacgtccagtggctcatgcccgagggcgtggagcccgcaccaactgcggcaaatggcggtgttatgaaggaaaaggatgggagcctctctgttgctgttgacctgtcacttcccaagccctggcacctgccagtgacctgcgttgggaaaaatgacaaggaggaagcccacggggtttatgtttctggatacttgtcgcaataaacgcacttgcctatttcaccttgttttagtgtggcattgggggggtggcattgcgggtggatagcctcgcgactcgtgggaaaatgggcggaagggcaccgtgggaaaatagttccaggtgacagcagcagtgtgtgaagattgtcacagctgctggtttggagaaaacgggggtgggcggtgatcagggagaacaattccccggggacacctgcacgagacccctgggctctcaggaactccgcccaggtcttgccaattggggtgatcctgtagcgccgcggtttcagcatcacaggttattttgcctgaagcttgctggggcgtaaatccctctcgccttgtttctcagagagcatttcaggccggttttgcagtcgctgctgcagctatggggtccctagaaatggtgccaatgggcgcgggtccccctagccccggcggggatccggatgggtacgatggcggaaacaactcccaatatccatctgcttctggctcttctgggaacacccccaccccaccgaacgatgaggaacgtgaatctaatgaagagcccccaccgccttatgaggacccatattggggcaatggcgaccgtcactcggactatcaaccactaggaacccaagatcaaagtctgtacttgggattgcaacacgacgggaatgacgggctccctccccctccctactctccacgggatgactcatctcaacacatatacgaagaagcgggcagaggaaggtaagagtgccatctatctgtacttttatttattgcatcacaagtcacatcaataataagggcgccatctagcgggagatgttatccacaccatcccaattcacatctcagggacaacaggtcaaagttctttgttgacacccccagcgctggctccagggggtggaagcgttggatgcagtcctccgcatcggggcggacgcctcctcccaacgcgtttctgcggatcagtcgctggctggtgggcatcggagtcggtgggcggtcctccacggggacacgctccttcttggccttgttctttgaccttttggacattcttctgaaggaacggcggagagtagcgtagaatccagccagtggtctacccggtcgcatggtggcttcttagatgaggagcaggcataaaagtccaaacaggacacagagtaccaccaggagtagtcttagtctgctgacgtctgggtcctcggggcaggggtggctaggcctggtctccgtagaagagccgggcaggccgcaggcagaggactgctgctctagcaaagcacgctccaggacgtgtaccatctcgagagtgaggcacagctgttttcgtggacttttatacagtaaggacaaggaaagaaggccagaggaatgtggaaagatgagcgaggacaggtgtggaggttttgggctagctcttagtttctgggtgtgagagagggattaaagtgcttatgcgcaaagaatgtgtcaacaacaggtgttcctgcctctgctggcatgagttaggtgtggcttgggctgaatccaaatgtgtattggcacaagatggaaagcaaagttgctggagttactgggtgggagacagggatgtatgtggtcccccgctggtatgccagtaccctgtggaagtaaggggcctcatctgcctggtagttgtgttgtgcagaggtctgatgtgtgtaggaggggtgggttcaacgcaggggcgttggtggcggagtctggcaacgcccgggtccttgctacctgtgtggtgtgttaagggctgggtaaaggtgtctgccaattctcgcatgtcctcctttccccttgttttgaaatagaatatgaatgtggcttttcagcctagacagacagtgtggctaagggagtgtgtgccagttaaggtgattagctaaggcattcccagtaaatggagggagagtcagtcaggcaagcctatgacatggtaatgcctagaagtaaagaaaggttagtcatagtagcttagctgaactgggccgtgggggtcgtcatcatctccaccggaaccagaagaacccaaaagcagcgtaggaaggtgtggatcaccgccgccatggccggaatcatgactatgaccgccgcctccgtctgtcatcaaaggcgggccctggtcacctcctttgttttcaacctcttccgtcaattgtggagggcctccatcatttccagcagagtcgctagggctatgaggcagcgggtcatgtgggccattgtcatcagtgttgtcagggtcctgtgggccattgtcatcagtgttgtcagggtcctgaggcagcgggtcatgtgggccattgtcatcagtgttgtcagggtcctgtgggccattgtcatcagtgttgtcagggtcctgtgggccattgtcaggaccacctccaggtgcgcctaggttttgagagcagagtgggggtccgtcgccggctccactcacgagcaggtggtgtctgccctcgttggagttagagtcagattcatggccagaatcatcggtagcttgttgagggtgcgggagggagtcatcgtggtggtgttcatcactgtgtcgttgtccatggtaatacatccagattaaaatcgccagaaacaggaggagccaaaggagatcaaccaatagagtccaccagttttgttgtagatagagagcaataatgagcaggatgaggtctaggaagaaggctaggaagaaggccaaaagctgccagatggtggcaccaagtcgccagagcatctccaataagtagatccagatacctaagactgcgttgaaaaaagagtgttagggttggaaaagtgggggtgtggtaaataattcctagggaatgttagatcttaccaagtaagcacccgaagatgaacagcacaattccaaggaacaatgcctgtccgtgcaaattccagagagcgatgagcaggagggtgactggggaaagaggagaaagtgcgttagagaaggaagagtaagggaaagggggtgtggggcaaagggtgtaatacttactcatcagtaggagtatacaaagggctccaagtggacagagaaggtctcttctgaagataaagatgatcaaaattataattataagcatgagagcaaaggaatagaggacaaggagggctcctccagtccagtcactcataacgatgtacagccaaaacagtagcgccaagaggaggagaaggagagcaaggcctagggaagaggagagggggggtcctcgagggggccgtcgcgggcccggtgggcccctctcaaggtcgtgttccatcctcagggcagtgtgtcaggagcaaggcagttgaggaaagaagggggcagagcagtgtgagaggcttatgtagggcggctacgtcagagtaacgcgtgtttcttgggatgtaggcccggggggatttgcggggtctgccggaggcagtacgggtacagatttcccgaaagcggcggtgtgtgtgtgcatgtaagcgtagaaaggggaagtagaaagcgtgtgtttgtgttagaaaagcgggtccccggggggcaagctgtgggaatgcggtggccaagtgcaacaggaaatggaaaggcagtgcggcaatcagaagggggagtgcgtagtgttgtgggaagcggcagtgtaatctgcacaaagaggcgcggggcgcgcaacgttgggaggtcgttggcggcaggcgggaggccgtgctttaggggggttcaggtgaggcaaggctgtggggtaaccgtaggggaggcgggtgaggcggctaagagggctaagggtcggcgggtgacgaagcagcagacggcggatatgggaatttcagaatgaggtggcggattcaggcgaaaagggtgtgggctgtgcgagtgtcatgaggcaggcgcggaaagtcgctgcggcttgctggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccgtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggggtgttggcgggggcatgggggggtcggatttcgcccttattgccctgttt

SEQ ID NO: 2 - DNA, 172764 bp, Epstein-Barr-Virus (EBV)
agaatttgtcttgctctattcaccgttacttttcttcttgcccgttctctttcttagtatgaatccagtatgcctgcctgtaattgttgcgccctacctgttttggctggcggctattgccgcctcgtgtttcacggcctcagttagtaccgttgtgaccgccaccggcttggccctctcacttctactcttggcagcagtggccagctcatatgccgctgcacaaaggaaactgctgacaccggtgacagttcttactgcggttgtcacttgtgagtacacacgcaccatttacaatgcatgatgttcgtgagattgatctgtctctaacagttcacttcctctgcttttctcctcagtctttgcaatttgcctaacatggaggattgaggacccaccttttaattctcttctgtttgcattgctggccgcagctggcggactacaaggcatttacggttagtgtgcctctgtgatggaatgcaggtttgacttcatatgtatgccttggcatgacgtcaactttacttttatttcagttctggtgatgcttgtgctcctgatactagcgtacagaaggagatggcgccgtttgactgtttgtggcggcatcatgtttttggcatgtgtacttgtccttatcgtcgacgctgttttgcagctgagtcccctccttggagctgtaactgtggtttccatgacgctgctgctactggctttcgtcctctggctctcttcgccagggggcctaggtactcttggtgcagcccttttaacgttggcagcaggtaagccacacgtgtgacattgcttgcctttttgccacatgttttctggacacaggactaaccatgccatctctgattatagctctggcactgctagcgtcactgattttgggcacacttaacttgactacaatgttccttctcatgctcctatggacacttggtaagttttcccttcctttaactcattacttgttcttttgtaatcgcagctctaacttggcatctcttttacagtggttctcctgatttgctcttcgtgctcttcatgtccactgagcaagatccttctggcacgactgttcctatatgctctcgcactcttgttgctagcctccgcgctaatcgctggtggcagtattttgcaaacaaacttcaagagtttaagcagcactgaatttatacccagtgagtatctatttgttactcctgtttagttgaagaaaacaagctattggattgtaacacacattttacgctttgttccttagatttgttctgcatgttattactgattgtcgctggcatactcttcattcttgctatcctgaccgaatggggcagtggaaatagaacatacggtccagtttttatgtgcctcggtggcctgctcaccatggtagccggcgctgtgtggctgacggtgatgactaacacgcttttgtctgcctggattcttacagcaggattcctgattttcctcattggtaagtgtgacaccaacaggtgttgccttgttatgtcaccgttctgacacatgacttacatgggtttggcttttgtaggctttgccctctttggggtcattagatgctgccgctactgctgctactactgccttacactggaaagtgaggagcgcccaccgaccccatatcgcaacactgtataaaggtaagtattattaaattttagagacactatcacgtgtaacttgacgtgcaaggatggaggataggggcagggaaacgcaaatgccggttgcccggtatgggggcccgtttattatggtaaggctcttcgggcaagatggagaggcaaacatacaggagcaaaggctatatgagctactctctgacccccgctccgcgctcggcctagacccggggcccctgattgctgagaacctgctgctagtggcgctgcgtggcaccaacaacgatcccaggcctcagcgtcaggagagggccagagaactggccctcgttggcattctactaggaaacggcgagcagggtgaacacttgggcacggagagtgccctggaggcctcaggcaacaactatgtgtatgcctacggaccagactggatggcaaggccttccacatggtccgcggaaatccagcaattcctgcgactcctgggcgccacgtacgtgcttcgcgtggagatgggcaggcagtttggcttcgaggtgcatagaagccggccctccttccgtcagttccaggccatcaatcatcttgtcctgtttgacaacgcccttcgcaagtacgattccggccaggtggcggcgggcttccagagggcccttctggtggccgggccagagaccgctgacacgaggccggacctccgcaagctgaatgagtgggtgtttggtggcagggctgctggtggcagacagctggccgacgagctaaagatcgtgtccgcgctgcgagacacttactcgggccacttggtccttcagcccacggagacccttgacacatggaaggtgttgagcagggacacacgaaccgctcatagtttggagcacggattcattcatgccgcggggaccatccaggccaactgcccacagctgtttatgagacgccagcaccccggcctctttcccttcgttagtgcaatagcatcatcgctgggctggtactaccagaccgccaccggccccggagcagatgccagggcggcggcccggcgtcaacaggcctttcagaccagggcggcggctgaatgccatgccaaaagcggggtgccggtcgtggccggcttctataggaccatcaacgccacgctcaagggaggagagggcctacagcccactatgtttaacggggagctgggggccatcaagcaccaggcacttgacactgtgaggtatgactacggccactatctcataatgttggggccattccagccatggagcggactgacggcccctccgtgcccttacgccgaaagttcatgggcacaggcggccgtgcagacggccctcgagctgttctcggccctgtacccggccccgtgcatctcgggctacgcgcgccccccgggccccagtgctgtgatcgagcatctggggtccctagtcccaaaggggggtctgctgttgtttctgtctcacctaccggatgatgttaaggacgggctcggagaaatggggccggccagggccacgggacctggaatgcagcagtttgtcagcagctacttcctcaaccccgcctgttccaacgtcttcattacagtgaggcagcgaggggaaaagatcaacggccgtaccgtcctccaagcgctcggacgcgcatgcgatatggcaggctgccagcactatgtgctgggctccacggttcccctcggtggactcaactttgtcaacgacctggcgtccccggtttccaccgccgagatgatggatgatttctctcccttcttcaccgtggagtttcccccgattcaagaggagggcgcacgttctccggtacccttagatgtggacgagagcatggacatctctccgtcttacgagttgccctggctctcgctggagtcatgcctcacaagcatcctgtcacaccccaccgtgggaagcaaggagcacttggtcaggcacacggacagggtcagcggaggacgcgtggcacagcagcccggggtaggtcccctggacctgccgctggcggactacgccttcgttgcccacagtcaggtctggaccaggcccggtggggctcctcccttgccctatcgtacctgggatcgaatgacagagaagctgcttgtctccgcaaagcccggcggagagaacgttaaggtttcaggtaccgtgattacattgggagaacaggggtacaaagtgtcgttggatctgagggagggaaccaggctggcaatggctgaggcgctgctgaatgcagcatttgccccaatcttggatccggaagacgtcttgctcaccctgcatctacacctggatccgcgccgggcagacaactcggtcgtgatggaggctatgacggcggcgagtgactacgcgcgtggcctgggcgtgaagctgacctttggctcggcctcctgccccgagaccggctcgtccgcctccagcttcatgactgtggtggcctctgtctccgccccaggggaattctcgggtcctctgatcacgccagtgcttcagaagacgggcagtctcctgattgcggtgcgttgcggggatggcaagatccagggagggtcgctgtttgagcagctctttagcgacgtggccacgaccccacgggcgcccgaggcgttgtctctgaagaatctcttccgggcagtccagcagctggtcaagagcggcatcgtgctgtcagggcatgacatcagcgacgggggcctggtgacctgcctggtggagatggccctggccgggcagcggggagtgaccatcactatgccggtggcctccgactacctcccggagatgtttgcagagcaccccggcctggtgtttgaggtggaggagcgcagcgtgggtgaggtgctgcagaccctgcgctccatgaacatgtacccggcagtcctcggtcgagtgggcgagcaaggtccagatcaaatgtttgaggtgcagcacggcccagagacggtgttgcgccagtcgctgcgcctgctgctgggaacctggtcctcctttgccagcgagcagtacgagtgcctgcgaccagatcggattaaccggtccatgcacgtttccgactacggctataacgaagcactggcagtctccccgttgacaggaaagaatctcagcccacgccggctggtgacagagcctgacccacgatgtcaggtggccgtgctatgcgccccgggcaccaggggccatgaaagcctcctggcggccttcacgaatgccggatgcctgtgccgacgggtgttctttcgcgaggttagggacaacacgttcctcgacaagtacgtgggtctggccatcggaggagttcatggggccagggactctgccctggcaggccgtgccaccgtggcgctgattaatcgttcccccgccctgcgtgacgctattctaaagttcctcaacaggccagatacgttctcggtggccttgggggagctgggggtgcaagttttggctggcctgggggccgtggggtcaacagataatccacccgcccctggcgtggaagttaatgtccagagatcacctctgattctggcccccaacgcctctggcatgtttgagtcccgctggctgaacattagcatcccggcgaccaccagctctgtcatgctgcgtggcctccggggctgcgtcctgccttgttgggtgcaaggctcgtgcctgggcctgcaatttactaacctcgggatgccatatgttttgcagaatgcccaccagatcgcctgccacttccacagcaatggcacggacgcctggcgctttgctatgaattatccaagaaaccccacggagcagggcaacattgcagggctctgttcacgcgatggtcgtcatctggctctcctgtgtgacccctcactttgtacagacttttggcaatgggagcacattccccccgcctttgggcaccccacggggtgctccccctggacacttatgtttcaagcagctcacctatggtcactcaggcacggtcgcccctccgagtgaccagtcaccttccagactatgcatacactgaatttagcctgatattgtcccccgagccccgggcccagccctcctcagaaaactctgcatggagaagctggacgtgaaccttccccccccccccgacctgtgtgctgtatttacaaacactacaataaacccaatgtgcaaatgtggtttgtatggctactttgtgttcctaaaaaatgcaacaatagaagtggaaaccctcagtcacgggacattaacctcaaccacaaaatgggggttggagaaagtaaccacatatactggagatgattcatgggctgggggttcccggacaatacacccatctggagttcaacttaattacatggtagataaattaagagtccctcctcaccactcgaaactatggcagacattctataagataacgaggagagatgaggtgagggcagaggacattgggcaggtgtgggccacggggcagctggccatatcccccgcaccacagaagtgtaagcaaagtgaagggctcggaaggcaggcggggcctagcaatgtcacagctaaatgcccaccagggcacacactcaagcggggtctcggagctcctaggtcagaccacgaaaggtcagcctgcaaggtggatggcgtgttttctgaggttatccccgctacgtgcagtgctgggtgagagagaccctagaatgtgtcgaaatgaccaagcgtccccgcagcggggctcccaacacgggttcccagagagggtaaaagagggggccataaagcccagggtgtaaaacaccgaccgcgccaccagatggcacacgtgggggaaatgagggttagcataggcaacccccgcctacacaccaactatagcaaaccccgccccgtcacggtgacgtagtctgtcttgaggagatgtagacttgtagacactgcaaaacctcaggacctacgctgccctagaggttttgctagggaggagacgtgtgtggctgtagccacccgtcccgggtacaagtcccgggtggtgaggacggtgtctgtggttgtcttcccagactctgctttctgccgtcttcggtcaagtaccagctggtggtccgcatgttttgatccaaactttagttttaggatttatgcatccattatcccgcagttccacctaaacggggcttaacgttgcatcccagaagatgcacacgtaaccccgcctacaaccgtgacgtggctgtttaccagcatatatagagttacggttcactacatcaaacaggacagccgttgccctagtggtttcggacacaccgccaacgctcagtgcggtgctaccgacccgaggtcaagtcccgggggaggagaagagaggcttcccgcctagagcatttgcaagtcaggattctctaatccctctgggagaagggtattcggcttgtccgctgtttttttgtggctagttttgcacccacaacatgtaagggcccgctacccctacaacacaaaacaaactatctccactaaccatccttttgccaatcaattctgtgacggggtttcctggacacccagtcttagttcaggtagacacccagttatgcagtgccaccaattccaaccatttttaaacctcctggaattctatcattaaacggcatgcaggaaaaggacaagcagcgaaaattcacgcccccttgggaggtggcggcatatgcaaaggatagcactcccactctactactgggtattatatgctgactgtatatgcattaggatagcatatgctacccagatatagattaggatagcatatgctacccggatatagattaggatagcatatactacccaaatagagattaggatagcatatgctacccaaatagagattaggatagcatatgctacccggatatagattaggatagcatatactacccaaatagagattaggatagcatatgctacccaaatagagattaggatagcatatgctacccggatatagattaggatagcatatgctacccaaatagagattgggatagcatatgctacccggatatagattaggatagcatatgctacccaaatagagattaggatagcatatgctacccggatatagattaggatagcatatgctacccaaatagagattgggatagcatatgctatcctaatctctatctgggtagcatatactatcctaatctctatatgggtagcatatgctatcctaatctatatctgggtagcatatactatcctaatctctatatgggtagcatatgctatcctaatctatatctgggtagcatatgctatccatcgcaacattagcccaccgtgctctcaacgacctcgtgaatatgaggaccaacaaccctgtgcttggcgctcaggcgcaagtgtgtgtaacttgtcttccagatcgcagcaatcgcgcccctatcttggcccgcccacctacttatgcaggtattccccggggtgccattagtggttttgtgggcaagtggtttgaccgcagtggttagcggggttacaatcagccaagttattacacccttagtttacagtccaaaaccgcagggcggcgtgtgggggctgacgcgtgcccccactccacaatttcaaaaaaaagagtggccacttgtctttgtttatgggccccattggcgtggagccccgtttaattttcgggggtgttagagacaaccagtggagtccgctgctgtcggcgtccactctctttccccttgttacaaatagagtgtaacaacatggttcacctgtcttggtccctgcctgggacacatcttaataaccccagtatcatattgcactaggattatgtgttgcccatagccataaattcgtgtgagatggacatccagtctttacggcttgtccccaccccatggatttctattgttaaagatattcagaatgtttcattcctacactagtatttattgcccaaggagtttgtgagggttatattggtgtcatagcacaatgccaccactgaaccccccgtccaaattttattctgggggcgtcacctgaaaccttgttttcgagcacctcacatacaccttactgttcacaactcagcagttattctattagctaaacgaaggagaatgaagaagcaggcgaagattcaggagagttcactgcccgctccttgatcttcagccactgcccttgtgactaaaatggttcactaccctcgtggaatcctgatcccatgtaaataaaaccgtgacagctcatggggtgggagatatcgctgttccttaggacccttttactaaccctaattcgatagcatatgcttcccgttgggtaacatgtgctattgaattagggttagtctggatagtatatgctactacccgggaagcatatgctacccgtttagggttaaaaagggggccttataaacactcttgctaacgccctcttgagggtccgcttatcggtagctacacaggcccctctgattgacgttggtgtagcctcccatagtcttcctgggcccctgggaggtacatgtcccccagcattggtgtaagagcttcaaccaagagttacacataaaggcaatgttgtgttgcagtccacagactgcaaagtctgcttcaggatgaaagccactcagtgttggcaaatgtgcacatccatttataaggatgtcaactacagtcagagaacccctttgtgtttggtcccccccccgtgtcacatgtggaacagggcccagttggcaagttgtaccaaccaactgaagggattacatgcactgccccgcgggaaatacgtcctacccaggaacccgaaacagtgtttcccagaagctgtaaaaatagaacgccctggaactgccccactgtgcaatgcagcttttagccatgccatgctctataaatcacttccctatctcaggtaggcctgcacaccttaggtatggagcgaaggttagtggtcactctgcagtgcctggtgctgctttacctggcacctgagtgtggaggtacagaccaatgtgacaattttccccaaatgttgagggacctaagggatgccttcagtcgtgttaaaacctttttccagacaaaggacgaggtagataaccttttgctcaaggagtctctgctagaggactttaagggctaccttggatgccaggccctgtcagaaatgatccaattctacctggaggaagtcatgccacaggctgaaaaccaggaccctgaagccaaagaccatgtaaattctttgggtgaaaatctaaagaccctacggctccgcctgcgcaggtgccacaggttcctgccgtgtgagaacaagagtaaagctgtggaacagataaaaaatgcctttaacaagctgcaggaaaaaggaatttacaaagccatgagtgaatttgacatttttattaactacatagaagcatacatgacaattaaagccaggtgataattccataccctggaagcaggagatgggtgcatttcaccccaaccccccctttcgactgtcatttacaataaaatgaaaccttttattcttgattgcctcttgtgttcttgccgcccaggtaccttcctgtgttctccccacgggaaaaagaatagcttctgcagaaggccattgacgcaagttttgcccgtggggattacccgacccggccacttacagcacattttgttctaggtccatcttaggagcccgggccagcattctatcagcttaacgggaagagaagtggggagggcactcgcccactaaccttaacacctgcagcctacaaaagtacactagctgtttgctctattcgccactagagaccgccaagatgcgaaactgcaggcccgggcccaggccttgtagggcagacggttaggctgacaaggggacaagtgtggcaggtgggcgggaaggggcacaagaatgacggcgaaactggaccacggtccaccccgccctcaagcgtccgggagccaggcggttcggttaaggagggcggccttgcgaacaatcattagtagctaccaacaagggcccccagatgccccccaccagtcaccccggccgtgtccactcacatattccactcttatttttaaattaatgtgtcccaattagaaacccaagcgcagaaattagttgagaggctagtgttttaaacatgcaccctaggccagccagagataatgtcacaagactatcaagttggtgtaaacacgccgtgggaaaaaatttatggttcagtgcgtcgagtgctatctttggaacagtagaaaattgaaccttgttggcgggagaaggcataacgccttatctgggaggagcgacggattatagccaataagagagctcaagacgcagggctcgcaaagtatagtggccccgtgggaccttagaggtggagcaacgtctaaagtggtaataacaccaggcggggctgggcaaaggggtcctacgggcgggattaattacgccttgcttacgcaagctcagttaattcgcccacgacttgaaaaatgtagcccttaaccaattggcggcccctaagggggggactaaggtcccactacaaaaactctgtgttctgctgcaaattttagataagatggcatagagacaaggacaccgaagacccccagagccctcatcgcagggttcttaccatgcggccatgtaggcccacttaacactacaagacctacgcctctccattcatcatgtaacccacaaatcatctaaaccgtaagtctaagggcctcctgaggttttctcaggaggccctaatgtataattaatcatgcatttgattttaaaaaagtaggttacactcattttaggccagactttatttgcagattaataatttatgtgattctccttccctctaggactgaagaaacagcctcctgcacgtgagcatgtatctgaaataattattatgtcataagtgtaatgattagaaagtcataaacccacttccctttacatgaatctgggcactgaattttggggtacttctaaagactaacgtgttcgatttcggggtcacttccccttttataagtgtgtgaacagtgatttcagtaaaacctaagagatatttggtgtcacttccgcattttaagtttcagaaaattttaaaattaaaattgaaatttctctcaaaataattccaatgaaaacttcaaagaatcttatgtatgtaattcttttgccccaaactgggcttcagatgccttctattgcactctcacaaaaacattctggacacatgtgccagacgcctgggcctctaaggccctcgggtccccctggaccccggcctcagcaaccctgctgctcccctcctgccaccccagcctccccccctccccgtcccccttcgctccttatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggacggcctaggcccggggaagtggagggggatcgcccgggtctctgttggcagagtccgggcgatcctctgagaccctccgggcccggacggccgccctcggccccccagacagaccccagggtctccaggcagggtccggcatctccaggggcagcaggctcaccaccacaggccccccagacccgggtctcggccagccgagccgaccggccccgcgccgggcgcctcctcggagccagcccccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccagggtgtcccccagaagggaccctaggcgtcccctctcctcccctccaggcccgagcctctccctcgcggagaggggcctcttcgagccctcaagtccagtcccaccgagacccgagtggcccggatcccccaccggcccttctctttccccctactcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagttccccctgcagccgcccagtctctgcctccaggcaagggcgccagcttttctccccccagcctgaggcccaggctcctgtgcactgtctgtaaagtccagcctcccacgcccgtccacggctcccaggcccagccccgtccacccctccccacgttggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcctggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggtttaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctccttatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggacggcctaggcccggggaagtggagggggatcgcccgggtctctgttggcagagtccgggcgatcctctgagaccctccgggcccggacggccgccctcggccccccagacagaccccagggtctccaggcagggtccggcatctccaggggcagcaggctcaccaccacaggccccccagacccgggtctcggccagccgagccgaccggccccgcgccgggcgcctcctcggagccagcccccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccagggtgtcccccagaagggaccctaggcgtcccctctcctcccctccaggcccgagcctctccctcgcggagaggggcctcttcgagccctcaagtccagtcccaccgagacccgagtggcccggatcccccaccggcccttctctttccccctactcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagttccccctgcagccgcccagtctctgcctccaggcaagggcgccagcttttctccccccagcctgaggcccaggctcctgtgcactgtctgtaaagtccagcctcccacgcccgtccacggctcccaggcccagccccgtccacccctccccacgttggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcctggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggtttaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctccttatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggacggcctaggcccggggaagtggagggggatcgcccgggtctctgttggcagagtccgggcgatcctctgagaccctccgggcccggacggccgccctcggccccccagacagaccccagggtctccaggcagggtccggcatctccaggggcagcaggctcaccaccacaggccccccagacccgggtctcggccagccgagccgaccggccccgcgccgggcgcctcctcggagccagcccccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccagggtgtcccccagaagggaccctaggcgtcccctctcctcccctccaggcccgagcctctccctcgcggagaggggcctcttcgagccctcaagtccagtcccaccgagacccgagtggcccggatcccccaccggcccttctctttccccctactcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagttccccctgcagccgcccagtctctgcctccaggcaagggcgccagcttttctccccccagcctgaggcccaggctcctgtgcactgtctgtaaagtccagcctcccacgcccgtccacggctcccaggcccagccccgtccacccctccccacgttggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcctggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggtttaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctccttatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggacggcctaggcccggggaagtggagggggatcgcccgggtctctgttggcagagtccgggcgatcctctgagaccctccgggcccggacggccgccctcggccccccagacagaccccagggtctccaggcagggtccggcatctccaggggcagcaggctcaccaccacaggccccccagacccgggtctcggccagccgagccgaccggccccgcgccgggcgcctcctcggagccagcccccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccagggtgtcccccagaagggaccctaggcgtcccctctcctcccctccaggcccgagcctctccctcgcggagaggggcctcttcgagccctcaagtccagtcccaccgagacccgagtggcccggatcccccaccggcccttctctttccccctactcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagttccccctgcagccgcccagtctctgcctccaggcaagggcgccagcttttctccccccagcctgaggcccaggctcctgtgcactgtctgtaaagtccagcctcccacgcccgtccacggctcccaggcccagccccgtccacccctccccacgttggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcctggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggtttaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctccttatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggacggcctaggcccggggaagtggagggggatcgcccgggtctctgttggcagagtccgggcgatcctctgagaccctccgggcccggacggccgccctcggccccccagacagaccccagggtctccaggcagggtccggcatctccaggggcagcaggctcaccaccacaggccccccagacccgggtctcggccagccgagccgaccggccccgcgccgggcgcctcctcggagccagcccccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccagggtgtcccccagaagggaccctaggcgtcccctctcctcccctccaggcccgagcctctccctcgcggagaggggcctcttcgagccctcaagtccagtcccaccgagacccgagtggcccggatcccccaccggcccttctctttccccctactcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagttccccctgcagccgcccagtctctgcctccaggcaagggcgccagcttttctccccccagcctgaggcccaggctcctgtgcactgtctgtaaagtccagcctcccacgcccgtccacggctcccaggcccagccccgtccacccctccccacgttggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcctggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggtttaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctccttatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggacggcctaggcccggggaagtggagggggatcgcccgggtctctgttggcagagtccgggcgatcctctgagaccctccgggcccggacggccgccctcggccccccagacagaccccagggtctccaggcagggtccggcatctccaggggcagcaggctcaccaccacaggccccccagacccgggtctcggccagccgagccgaccggccccgcgccgggcgcctcctcggagccagcccccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccagggtgtcccccagaagggaccctaggcgtcccctctcctcccctccaggcccgagcctctccctcgcggagaggggcctcttcgagccctcaagtccagtcccaccgagacccgagtggcccggatcccccaccggcccttctctttccccctactcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagttccccctgcagccgcccagtctctgcctccaggcaagggcgccagcttttctccccccagcctgaggcccaggctcctgtgcactgtctgtaaagtccagcctcccacgcccgtccacggctcccaggcccagccccgtccacccctccccacgttggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcctggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggtttaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctccttatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggacggcctaggcccggggaagtggagggggatcgcccgggtctctgttggcagagtccgggcgatcctctgagaccctccgggcccggacggccgccctcggccccccagacagaccccagggtctccaggcagggtccggcatctccaggggcagcaggctcaccaccacaggccccccagacccgggtctcggccagccgagccgaccggccccgcgccgggcgcctcctcggagccagcccccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccagggtgtcccccagaagggaccctaggcgtcccctctcctcccctccaggcccgagcctctccctcgcggagaggggcctcttcgagccctcaagtccagtcccaccgagacccgagtggcccggatcccccaccggcccttctctttccccctactcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagttccccctgcagccgcccagtctctgcctccaggcaagggcgccagcttttctccccccagcctgaggcccaggctcctgtgcactgtctgtaaagtccagcctcccacgcccgtccacggctcccaggcccagccccgtccacccctccccacgttggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcctggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggtttaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctccttatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggacggcctaggcccggggaagtggagggggatcgcccgggtctctgttggcagagtccgggcgatcctctgagaccctccgggcccggacggccgccctcggccccccagacagaccccagggtctccaggcagggtccggcatctccaggggcagcaggctcaccaccacaggccccccagacccgggtctcggccagccgagccgaccggccccgcgccgggcgcctcctcggagccagcccccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccagggtgtcccccagaagggaccctaggcgtcccctctcctcccctccaggcccgagcctctccctcgcggagaggggcctcttcgagccctcaagtccagtcccaccgagacccgagtggcccggatcccccaccggcccttctctttccccctactcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagttccccctgcagccgcccagtctctgcctccaggcaagggcgccagcttttctccccccagcctgaggcccaggctcctgtgcactgtctgtaaagtccagcctcccacgcccgtccacggctcccaggcccagccccgtccacccctccccacgttggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccgcccaagctgctttgattcctgggatatttttgggaatggtgttaactttctccccttgtatttgctattcaatcaacctgattccccctgctcatacctccactcacaaccaagccactacggccacgtccacaacctcccgcacaggtaagtgcttttccatttttagccccagccccgcctctataagttctaggcaaacctccaatcaccagccaccttccaatgtagtctcttagagagtggctgctacgcattagcgagagatttgacccacacccagtagccacccgacgccaatctgtctacatagaagaagaagaggatgaagactaagtcacaggcttagccaggtgatttgtgaatttcagtttatttactttcttccaatcaagctttcccagcctccgcttctcaggtcccagttatgggttttccatgggggacctagtatccgttctattagattaactcgcaagatactaaaattaaccaaggtcagcccaagtgacgcgtgttatgccaggctgcccaccctgaggatttcccccaaaaatgggctgttagtagggtcctcctaccccctctttaggccaggtgtgttattttgttgtgttagtgctatgtaatgtgttgccgccaggtggcagcttgtttgtagatgtgcagcgccccttaatggtaggtctgctttagggctgccaggtggcgcaaactaggattaattcacctgtatccctttccctccacccgcagtaactcagcgctggcgtgtgacgtggtgtaaagttttgcctgaacctgtggttgggcaggtacatgccaacaaccttctaagcacccgcgcttgtgttttgctttatctgctgccatcatgcctacatactatcttgcgttacatgggggacagtcatataatctaattgttgacactgatatgtctggaaacccgtcactctccgtaattcccacgaatccttaccaggaacaactatcaaataatccattaattcaactacaaatcgttgtcggggaaaacactggggcacccgcaccgccccaaccaccccccccaccccctccacctcctccacctgagcgcagggatgcctggacacaagagcccttaccactggatatgaatcccctgggcagtgacgccagtcaaggccctctggcatcttccataagaatgctttgcatggctcaataccttcttagaaacgcacggggccaacaaggccttcttaggccactaggaccacaaacacgctctcaggtcaccttggaacgtcaacctgtccacaaccctcgccaggaggcacccatcattttgttacagagtcccgcgcccccccgattcacaccagtgcccatggtagccttaggacatactcttcaacccacaccaccaccaaggcctactcttcctcaacccagaataccactgataataccaccaaggcatactaatcaaccagccacaacaccacccacggcgccacaaaggctcacactagggcatcaactaagtctaccaccgcatcctcccccgcatcagagcaccccacattgtagttctgatagtacaggactccctccacctcccacatcttacagcattccttctatgacattatcccccgaaccattgccgccaccagcagcaccagcacacccccttccaggtgtcatttatgaccaacaagcacttcctccaactccagggccaccatggtggccacctgtccgcgaccccacgccaaccactcagactccaccaacaaatacgaaacagggcccggaccagggccagggaaggggcaggtggcggggcaggggcagaagcaagggcaggggcagaatgcacaaacttcctgaaccacggagaccagggccagacacttccagtcctagtatgcctcaattaagtccggttgtcagtcttcatcagggacaggggcctgagaactcaccaacccccggcccgtctacggccggccccgtctgtagagtgacaccttcagcaacccctgacatttcaccaatacatgaaccagagtcctctgatagtgaagaacccccctttctcttccccagtgattggtatcctccaacgttagaacctgcagaattagatgaaagttgggagggcatttttgaaacaacagaatctcatagctctgatgaagagaatgtaggggggcctagtaaaagacctcgcacctccactcagtaaaagaccttactctctccagtaatcaatgtatcccaaataaatgttaatgattttgttcttaactattgacccgcctgtcattctattaattaaacaagggaagctatgtttagctattccaccaacactgcaccaatggacagccaaaattggtgccttgctcacagctctttttgccagtggcttacagcccagtaggcagctcagaaaagtttagctattccaccaacccggccccaatgaatgcttgccaaaattggggccttgctctcagcactttgccagcgacttatagcatggtaggccgctcaactcggcctgtcttactgcccagcctactctccacttccagtccatgttcgcactcctatgcatttccttccctcccacttttatcccagtcccaacccaaaaccacacacaacacatagaattgttagtttaaacagtttattgatacatggctgcttttagcctaattgtgtattgctctcgttgccaaaacctggtgtaagggccggcacccgcaacatggggaaaacataaccgccgccatcccatggggagggtagaggcggttgacatgtaggtgagtagtgtaagaagcatggcgaagtagacaggttacttttagagtgtagtgtacagggccgggcgcaacagtgccaccaacccggggtctgagcattccatgggcagcagggacactgcactaccgccaggtccaggggcagccggggttcctggcgctccggggggcagccaggcggccgccggtgggtccgctgggccgctgccccgctccgggtggggggtggccccgctgggcaccgctgcgccgccgccaggtccaggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgtgccgccgccaggtcctggggcagccggggttcctggcgctccgggggcagccgggcggccgccggtgggtccgctgggccgctgccccgctccgggtggggggtggccccgctgggcaccgctgcgccgccgccaggtccaggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtccaggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgtgccgccgccaggtcctggggcagccggggttcctggcgctccgggggcagccgggcggccgccggtgggtccgctgggccgctgccccgctccgggtggggggtggccccgctgggcaccgctgcgccgccgccaggtccaggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccactgcacctggaatgcagggtgggggcgtggtcccctggaccccagccccgccgatccctcccccagggcgtacccggcttgcctggttctggggctcctctgggggtcgctgcatccgccggtagggttcgaatgggcgtggtccgcttgctctgctggcccggtacgcctggattgccggctgggggctggggtcccgggacgccccctccctgctcccacccggttccctcccccagggcgtgccccgcttgcctggtcctggagctcatccggggatgctgcatccgctagtccgacctgggtgggtgcggtccgctggccccaccctgggggtcgccgccgggtctgctggtccggtgcacctgaaaggcagggggggggcagtgagggaggggcgtggtcctgggaccccgcgccgactggcagggggtccccatggcacaggcctaggggtccagggggcagccgcggcccagcgcgccccgttcacgggggaggaccgcggccgagccaccaggggcccggcgggggtggggggtgcgctcccaggccggaccctggtgccaggcagggaccccgcgccacccgcttcatggggggggaggccgccgcaaggacgccgggccggctgggaggtgtgcaccccccgagcgtctggacgacgctggcgagccgggccggctcgccttcttttatcctctttttggggtctctgtgtaatactttaaggtttgctcaggagtgggggcttcttattggttaattcaggtgtgtcattttagcccgttgggtttcattaaggtgtgtcaccaggtgggtggtacctggaggttattctattgggataacgagaggaggaggggctagaggtccgcgagatttggggtaggcggagcctcaggagggtcccctccatagggttgaaccaggagggggaggattgggctccgccccgatatacctagtgggtggagcctagaggtaggtatccatagggttccattatcctggaggtatcctaagctccgcccctatataccaggtgggtggagctaggtaggattcagctaggttcctactggggtacccccctaccctaccttaaggtgcgccacccttcctccttccgttttaatggtagaataacctataggttattaacctagtggtggaatagggtattgcagctgggtatatacctataggtatatagaacctagaggaagggaaccctatagtgtaatccctcccccccctacccccccctcccttacggttgcctgagcccatcccccaccccagcaccccggggtgacgtggcaccccgcgtgccttactgacttgtcacctttgcacatttggtcagctgaccgatgctcgccacttcctgggtcatgacctggcctgtgccttgtcccgtggacaatgtccctccagcgtggtggctgcctttgggatgcatcactttgagccactaagcccccgttgctcgccttgcctgcctcaccatgacacactaagcccctgctaatccatgagccccgcctttaggaagcaccacgtcccggggacggaaggggacttggggtgattttctatgtgggggtggaaatatgagcaagaataaggacggctccttattaacctgatcagccccggagttgcctgtttcatcactaaccccgggcctgaagaggttgacaagaagggtcaaggtttcgtctgtgtgttgaagggcaggggctgttgggtgcatctggaacggcttacctcgggtaactgtttgccattaaaaggttggggattaggtttagcccctttagctgccatttcgaaccggggtgtgcagatgcaggtctccgggtgggcaggcagtacgagatgtcacgttgtgttgtctttcctcccacccctgtcctggctgtggcaaatgcgaccctcatagagttgtgtttcaggtctgtgtcctgttttgcggtgggttatttcccccctcagtgttcgccagcttatttccccagtccccacgtactggggcctgtggacacctgagggagcggccgttggtgggcatgtgttggaattgctcccaccctcaattttcgcttgccttcttcccttgttaacctgatagcatagcctctaggtttccttgtaggtctgtttgggtttgttggttcacgtggtgctaacttgaattttttggttttctagttccctcttaattacatttgtgccagatcttgtagagcaagatggcctattcaacaagggagatactgttagccctgtgtatacgggacagtcgtgtgcatggaaatggtaccctgcatcctgtgttggagctagcagcaagagaaacacctctccgcctttcgccagaggacactgtagttctgcgttatcatgtgttgcttgaggagataattgaacgaaattcagagacatttacagaaacttggaacagatttataacacacaccgaacatgtggacctggattttaactcagtatttttagagatatttcaccgtggagacccaagccttgggcgcgcgttggcctggatggcctggtgcatgcatgcctgcaggacattgtgttgtaaccagtctactccttactatgttgtggacctgtcagttcgtgggatgttagaagccagcgaaggcctggatggttggattcatcaacagggcggctggtctacattaattgaagacaacattcctggatccagaaggtttagctggactttgtttcttgctggactgactttgagtctgttagttatatgtagttatttatttatctccagaggaagacactaatctatacattttctcagcactttatatgaatcagggtcattgggcctgcggggaactgagccagtaggatattaggcaagggtgacacagtgcccatgcattataatttaaccaaacagtggtcgtgagttttaggccggccatgggggcttacaagaataacatgccaatgacccggcccccacttttaaattctgttgcagcagatagctgatacccaatgttatcttttgcggcagaaattgaaagtgctggccatatctacaattgggtgtcctaggtgggatatacgcctgtggtgttctaacgggaagtgtgtaagcacacacgtaatttgcaagcggtgcttcacgctcttcgttaaaataacacaaggacaagatactaaagaaataactgaggtgagtgtgggaagatgggaatactatgtgttatgttaacgggtgagagcctatactgcagcccagactcggggggaggaggaaatggtaagagttatactctacttatcttttttgacactacatttaactgttatgtaacaatgtttgcttattttcatgttcaataaacgctatgttaatgatgaagaacctgtgttctttggaagtgggcccaatggggtagtaggttttgggagggtgccgtgctagatatttcaactgccacagaccccattttgtcccacctgttaccacattctaggtcctgcatccagtgggccaggtgtctcaccatggctctttctaggtggataccacagtccaggcccccaaggctaccgtgctaattacctcctcatgtccacccccaccctgtgttactgtcgcctgattatcctggcttagcagcctccaagttttacaagacgtcccattgccctgcccttggtccaagtctcgcctgttttcagcagcctgttgtagcctgcccccaagtttcgcaggtttcccccatgcttccacccgttaacccaatagcatgacagccaatccaacacgaggcaagttttaagagttaaaagcaactactgtttattttccaaaatgagctgggtatagttgatgatctgtaggcgcagctcatccccacattccaggtccttgatggcctcgtagatggcatcttcgtcgacattgacagccttctcatataccgtgtctctggggctgacctttatacagaaggcgtcccctactaggtccacggccagctcgtaggtggggcctatgttttcacataacagtttcaagcaggtctctgggatgtgaagggaggtgccctggagcaggagatgcatgattaggcgcccttttccatttgtgctgaagatggggcagatggtgccacaaaagtgtccggtgaccaggtaagcgtagagaaggctgggttgggaaagtccagcctttactgcactgggagagctgctgagcagagacacatagaaggtcttgttgggtattatcttgtggacattgttgaagaaggagagctgggtggagctaaactcctgaggcacatgaacctgggacctattgatgcagatctcgcagtgagaccccagagtcaggctgtggccgaagggagacaggcgaaggcagcgcccgggggagagagtgcacagtgacagtgggagaaacacggcctctgagacatgtatgggggtgttcatctcacgcagaaaatctttgcccagctcaaagttggcagagattcccctgaagaagtcccgtagtgaaaaatgggatctgtctacaccatgtctggtgtgccgggaacatattgatcgggccacactgccaaccctttccattcttcccagctctgagcgagattttccacacctggacaccgacttcacgctatgcgccgaggcctttgaggccgtgtagtttctgtggtgcggatgcattaggcggcgcaatgcgggatctgccggtcgctgttggcgtgcattcacggcatctggggtgaccggggccatcgggtttacttttcacacgtagacctgggaagtttgataggactgtaccaggtcaaggccgtggatgcgcaggaccacgtccagttccttagtgacatccacgaggattgttttgcccactctggccacttgtgtggatttaaatatgtacacaagcgtaattaacgagtcacagaccccctgttccagattctgaccggctgcaagcgctgccttaaaggcctggaagctgggtgggtaaatctgaccaaacagcacgctcggattcgtgatgctgtggttgatggcacacagggggtcgcagaacaggtgcttgtggaagtcttgcggggtgcacatctgcagccaggcccttagcctggggcatggcacatccagcagcgtgttttgggtcttgatgaggaacacgatcctgtctaggattttgatgttgttgccgaacgagtcaagaatcaggctcttgaagcggtcaagggtgtccttggcgtccgggtgggccccgaggctctcgcagagtgggcagatggtccgtgaggcattcttgtgccttagtccaaacatgggggccaggaggcaggggccctgcgaatggtcgccagcctccggtctggtgatggccagggccaactccgccagctcatcgccgctgtattccgcgtttaaaccgatagcatggtggcctggccccccgagcaggtccgtcccctgccacgtacctaatagtagtccacagtagtcggccttggttgtaattttaggagagagtcctcccttttcggccctgagaaatggatgctgaactcggtttctggtaggcaggtggcagcacagggcggtgtacaggcccctgccgacgtcccctgggacatcctgggaatctttgcaggttctgggtccagggagggtaagaaaagtgggggtggttctgggccacatggacttgaagcagaagttggccggggactggccggtgaggatggatttcagaaactccaatttgtagtagccgaggttggcatttctaatcatgtcagaagaggacacagggaggaagcaccggcaaatgtaaaagtgaagctggatgtcaatggcaagaatcctggagggcatgaagagggaatccaaccccccggccatggggaagtattttatcaggatgtgtaaaaagtccatgcctgtgatgaggctagagatccaggctcgtggggcatttagacagtagtagcagagcagggcatagtcctcaaagaaggccacgggggcatctgagtgattgaccagggtgtcgagcagatcacaaactcggcaggtgctggctggagagagggactcgtaggtgtggacgagtggtgggtaggctatgccttcttccgcgttggctggaagataggagtgggccatcaaaaggccgactgcctcgaactggcttttcagattgtccacggtccagggcacaaagtcctccatctttggagttctgcccgcgatctgtgccacctctgttacgccactcctcgtgagggggcagctggacagtctttttccggtcagggggtttggctcgtttgcgctcgtgactttgtgagccatgacacatctgggtggcaaggtgaggtcttctgggtttttaataccggggtcggcaccagtttctgggacaccgccacaaggacaaggtgggctagcaagttctcgagtctacgaagactccgggggcagtcttttgagtttctcgcctatgatccaccccaatctcgcccccctaattgcgccatctgcctacgcgaggctgaacctcctgaatcactgcatctttcttgaggcgtttaaagaagagaatagtggccagggcctcggtggggtccagcgtgaggtcttatttttgaaaagggatattataaaacaggtcattgctcggattgtggcagccgatagcaccctagatctagtgaatcatggcgagcccggaagagaggctcctagacgagctcaataacttaattgtgtcatttctgtgtgactctgggtctctggaagtggagagatgctccggggcgcatgtgttctccaggggcagctcccaacccctctgcaccgtgaagctgcgccacggacagatttaccacctggagtttgtctacaagttcctggcctttaagctgaagaactgcaactacccttcctcgcccgtgtttgtgatatccaacaacggcctggccaccaccctgaggtgctttttgcacgagccgtcgggtctcagatcgggccagagcggcccttgcctgggtctctcaacggatgttgacctaccaaagaactccatcattatgctgggccaggatgacttcattaagttcaaaagccccctggtcttccctgctgagcttgatctcctgaaatctatggtggtctgccgggcctacatcacggaacaccggacgacgatgcagtttctggtgtttcaggccgccaacgcccagaaggcctcgcgggtcatggatatgattagtgatatgtctcagcaactgtctcggtctggtcaagtcgaggatacgggcgccagagtcacaggtggaggaggtcccaggcctggcgtcacgcactcggggtgtcttggggactcacacgttagggggcgcggtggttgggacttggataacttttcagaagctgagaccgaagacgaggcgagttacgctccttggagggacaaagactcgtggtcggaatccgaggcggcgccgtggaagaaggaactcgtgaggcaccccatccgcaggcaccggacacgcgagactcgccgtatgcgcgggagccattcacgggtggaacacgtgccccccgagacccgggagacggtggtggggggagcatggcgttattcttggcgcgccacaccttatctggcacgggtgctggctgtcacggccgtggccctgctcctgatgtttctgaggtggacctgacgttgcaggcccttggggagcgggggttctccaggctcctggatctggggctggcctgcctggatctgagctatgtggaaatgagggaatttgtggtttggggcaggcccccagcttctgaggcggctgtggcctctacgccaggctcgcttttccgaagccactcgtccgcctactggttgtcggaggtggagaggcccgggggccttgtccgctgggccaggtcacagaccagcccctcatccctgaccctcgcgccccatcttggcccgtccctcttgtccctttcagtggtcaccggtggtgggtgtggagccgtggccttttgcaacgcctttttcctagcttattttttggttgtgcggtctgttttccccgcgttttccgatagaatagctgcctggatctgcgcccagtcccctttctgcgaaaacacccgggccgtggccaggggttaccgaggcctcgtgaagaggttcttggcattcgtgtttgagcgtagtagctatgacccccccttgttgaggcaaaactctaggcctgtggagcgctgctttgccatcaagaattatgtcccgggcctggactcacaaagctgtgtgacggtcccgagcttctcccgctgggcccagtctcacgccagcgagctcgatccccgggagattcgcgacagagttacaccagcgactgcaccttcgttcgtggctgatcatgcctcggctctattggcctccctccagaagaaggcctccgacaccccctgtgggaatcccattcagtggatgtggtaccgcctgttggtaaactcgtgcctgaggagtgcccactgtcttctgcctatacctgccgtctctgagggggggagaaagacgggcgggggcgtaggggaggatctcgtgggggccggggggccctgcctgagccgggatgttttcgtggcgatcgtaagccgcaatgttctctcgtgtctgctgaacgtgcctgccgcgggtccccgggcctacaagtgtttcagatcccacgcctccagaccggtgtctggcccggattaccctcccttggccgtgttttgcatggactgcggttactgcttgaactttggaaagcagacaggtgtaggaggcaggctcaattcctttagacccactctccagttttatccccgtgaccagaaggagaagcatgtgctgacctgccatgccagcggccgtgtgtactgctccaactgcggctctgcggcggtgggctgccagaggctggctgagccaccgagcgcccgctcgggctggcggccccgaatccgggcagtgctgccgcacaacgcggcctacgagctcgaccgtggctcccgcctcttggatgccatcatcccctgcttgggacccgaccgcacttgcatgcggccggtggtcctgcggggggtgacggtcaggcagctcctgtatttaactttgcggacagaggccagagccgtttgctccatctgtcagcaacgccaagctccagaggacgcccgcgacgagcctcacctgttctcctcctgtttagaggtagaattgccacctggtgagcggtgtgcgggctgccgtctctatcagacgcgttatggcacgccggctgcccaagcccaccctccaggggaggctggaggcggattttccagacagtcccctgcttcctaaatttcaagagctgaaccagaataatctccccaatgatgtttttcgggaggctcaaagaagttacctggtatttctgacatcccagttctgctacgaagagtacgtgcagaggacttttggggtgcctcggcgccaacgcgccatagacaagaggcagagagccagtgtggctggggctggtgctcatgcacaccttggcgggtcatccgccacccccgtccagcaggctcaggccgccgcatccgctgggaccggggccttggcatcatcagcgccgtccacggccgtagcccagtccgcgaccccctctgtttcttcatctattagcagcctccgggccgcgacttcgggggcgactgccgccgcctccgccgccgcagctgtcgataccgggtcaggtggcgggggacaaccccaagacaccgccccgcgcggggcacgtaagaaacagtagagggcacgaaacatggtgtatgcactttattaataaacaattacagatacaaaaacttgagtctctcgaggtctgcgatgaggcggtgggtggaacgctccagcttgcggcgaagctggctcacgaagcgagacagtactcggctagcctgactaagggtgaggctataacgcaggtcctgttccggggcggcggtggatagagaggagggggatccggaggggaccactaggtcgccggaggtcgaccctcctgtcaccacctccctgataatgtcttcaatagacagaaattgggtgaccactgagggagtgttccacagtaatgttgtctggtcgctagatggcgcgggtgaggccacgctttgcgaaaacgaaagtgcttgaaaaggcgcgggatagcgtgcgctaccggatggcgggtaatacatgctatccttacattttggcattttgggcagctgggaggcggcggatgggggtgcttcttttcgcacggtgtatgtttggggacccgcatgccggtactgggataggcgcacctcgggccgcgcgccaggctccgagccggaatgcattgggggcaatgggattgcgggggattgttgctgtctgctcctgacagggagagacacgcgcggcggagatgcagccgacggcggggccgcggtgggctgcccccgaggacgggcgccggccgccagcgcccccgtggcctttggcacgggcctggcacccaccgctttaattgtgggggtgggcagggcagctgcatcttggggcctttgtgcttgcgttttttgggggcgcggtgccaatgcaccaactggggtgtgcgccggggcggccaagccggaccccagggcgggtgcctgggggatgggaaagccggacggcgcttctcccgggtcgaacgctggagtagcggaggctgctgcgccggcggccaccacgggcgcacggggtcgcagcccgacggccgtggggaggcgggtggcggagggccgaatctccgcggcttcttcccggcccccctgctgtttcttctcccgttgcatgatagaatggccatagggtgggtcctgagaggaggcttgtgtgtcctggggctggagcccaaaagtcgttaaagacgctgctgatggtgtgggagctatgcctcccgtcgactggccgggcttgtagggggctgagggtggataactgggcttctgtgaaggcaccaaccctggaatctggatggtatgtttcttctgtgaccccgaggcagtcgatggtgtagagtttggagacaatgtgtagacgatgggcccttgttcagaagcccagggacttgaggggggctgttgtggtgctggttggggaaggagctccagggaatctttgggccatggccttggggaggttcccggagaccggtctgggctctcggaagccctcgtttcggccccgaaatagggccttgccatcaatcgggggcctgggagagtgatgggggcggccaatcccggggtaactgtcacgtcccggggggaggaggtaggagacagccagtccctgggcctgccaggggccaccttctctaagagggggctctgtgggctgggagggccagaggcctcagattcagcagtagtgctcccctcttccccctggtccgtctcccctcctcccaactgctggagccggtcggaggaggccggggtgttatctgctgactgaaacccgtccccgctgaccagtccgtgccccacccttggggggaaaccggagaacagctcctggacgttgcgtggattcgggggaagctggtatccaaccggcagtggaggatcttcgtgctcgtagaaggaggggttgagtacatcggtcggccatcgtgaggccccggccgcgttaaagtagaactgcacgtccggcagattgtgccgataggtgaaacacttccagatgatgttttttctgttggccaggatggccacggtggggggcctggcctccttaggtttggcggccctggcctcggtgagaagctcgcgtagccacacggcctggcgtgcaaagatggacatctctggctcgaaagactcggagtagccgtccaggtcctgcagaaaattcagcgagatggtctccaccagggaccggaagggctcagagtgcccgtcgcagtagaggaggggagcaacgaccctgacctgtcccagggtcttcaggttaaacagatattgagaggagacaaagagagttaggggccgaccgaggaaggccgccgccacggccgcctcaaaaacggagacggggatggtgtcaccggagcccctcttaggaccggtaatgggagtgccataaggcataagatttctcagggcccggccggtaacggtgccgtaggaagacggggtttcgcgggggacctcgagtccctccgccctggggagctcttctccgcgtgtataggcctgcttcacaaagtcgcgcaggtagtcctgaaatgcgaccgggccctccagcgggcgcaatgagtgccagagctgctgaagggcctcgggggcgaagcaccggcgtgcgaggagcagcatgcaggctcgggcgcgggccgtactttggttgtggaccaggcccaagaactcggggtgcggccagagggcggcccgggtatccatctcctcccaggcgtcctggaagaagatgaagccggtgggtggaccggcgatgcggtggcgggtgaggcggcgcgcgtcttccccgtcgttgctgccgcgggtggttgagggcatgccccccctcccggaggctggactcctgaccagcctgtaggtgaggaccgagtccgacaggaggtctcccaaacccccatctctcgctagagccgagaccaggccgagtcctgcgtagaacgatggggcgcccaggaaggcggcagcgtaggccggatgtgtgccgaccagcagcgccatcatctcccgttgttccaatagaataacttcccggtctgtggccggggctggataaggggggtgattcctagaggcgatgagactggcgtgcgctaaaagcgtcatggccacaatggggttgtctgccaggtcttccatcagggctttgggcgcagagacgtattcccgaagcagctccccggcgttggactccacgtcgggccaggtgtcccagtaggagtcggcggcggcggcgctgaggcgggcggaagctacactggccagggttcttctcctcctctcttggtcatcctgcgggggaccaatagcttgggggcgtccggctggggtcagggaaaaggcctctgggttctccagcacggtgggcatgacatattccagaaagttgtggtagacggggatgtagttgagcggctcctgggtgtctgcggagacgtaggccgggttaagggggtcgcagggagactctgtttccagccagagggtgccggcgtatttcgccggccctgccgccgccagaaattgtgcccgccgggtcggggctccattgccccatccagttggtggtgccgaaatcgtgatgaggaggggcaggttgttggtcaagggatgcttaacgaaaacggtaggctgggcggtctcgtaaaaagccaggaaactctgcttggccgaggcatagcgcagcagcttgtccttgaggagtgcatactgggagccagccgaggccccaagcgccaggcccctggcagcctccaccacgatcttgagctggcgcgggtcggtgtggcccctggcctgggtgaccagatcctgcagcgttccctgcagctgggactcttcctgggcctcctggatgatggcctccagtcgggagaggcgccttttccagtctgcgacggtctccttgccccccgcgacccgcttggggtccaacgtggccagagccaacctcagctcctccatgccatccatggagttctgggccatgccctcgacttccaggagccgtgttagctcatgaatttcaccgtcagccgcagcggctaggttcagccaggcacccacacccccagctaaggccagggctccttcggaaagaccccgcactgcctcgcagatgccccggatccacttggcggctgccagggatttccggtagggccacgagccgttcccggccgctgcccgggccagggcggcctcgaggggagcctggacaggggctttgggcggggaggggagcaggctccggagttcatcgtcgggggcttcgtcgcgtgacctggagaggacggcctccagagccgtgtgaaagccccgccgagtgcttgccgccatctcgtgggccttcgccatcagggtctggctctcccggacctgctcttccagcgcccggacctcggccgcctcggcctcggtcagcagctctgagaagaagtcccccgtggcctggaggagatcgtcccgctctcgccttgtcagcagctggggcttcttaggccagagcgccgagtccgaggccagcctgggcggggcggttgcctgggggatagttggaggaggaggcaggttagcctggcctgggtcattagtggcttcgggtagcgtccgatccacgtactcgctcacgatggccgtcagggcagcctcggctgatcgtcttttttccagaagcccggccagcccccgctcgtactccgcgtagggggcctccagatccgtgttgaccaccgctgatttcatgtccggggactgcagggcctggcgcgtctgcgcgagggccgaacggatggcatcggccgccgtcctggcacgaaagagggccccggccgcttcctccgctcctcgccctcctcctccttctttggcggtagccgcgggggtggcgggccaagcgtccagtctggccagagggccggtctcgatctccgtgaaccagccgggttccacggcctccattctctccgccgcaccaccatcgtccacgagcagggatcgcagtctctccctcctcaccctcgttattcccaatagcatagcggcaaggatctgtgtgagggagtccaagatgtccgtgtttctggctactgccgccgctgctgccgcggctgagtccgtattgtctggcagcagggaggccagcagggtgttccagtcatcgggcgaagtgggagcgggctctgggcgtgcccccagcgccttcctaattctggcccaggcctcattcgcctctcgcgctcgccgctcccgcctctccttgtcttcctgttctcggagcttctccttttccttgcgcccggtctccataagctgccgcagcttcttctcatactgtcgcttgagctctttgttgggggcagtgtccagaaaggcctcgagctgttcctcggtggcgggcttaaagccttcggcctccaggcgccaggcctgcacctccttctgtctgagctgatcgttgttgttattcttcaatttctgcaggtaacttaggaagcgtttcttgagcttccctgggatgagcgtttgggagagctgattctgcagcccagagagtagtctcagggcatcctctggagcctgacctgtgaccgtcgcatcatagaccgccagtagacctgggagcagattcaccgccgcggccgtctcctttaaggtgctgtgagtagcaaaattctgcaaggccactaggcgcgctggctccagcgtcagccggttgcccatctcgaatgtgtgcagggcctctgagaccatggggtccaggatgcggtcaatgccatcctgcacctcagggtcaaggaccggcaagtcacgatagaggtggtctatgctctcctcgaaggaggcaatgtagttatcgatggtgtagaaggtgatggatttcaggatgttcatcaggtactttttggagcggacaatctgctgtatagtgtcacgtaggcggatgtacgtggggttctttgcggccccgactatcgaccctgcatttgcgatgtacttttctatgacggggatggtgagggccgcggtgtcggccagtggtggcgtggcttcggggttgtcgtggttggcgggtgtcgcagagggagaggcgggagagatgggggcgcctggggccgaggccacaccggccaggcccaacattgcctcgatgtcgtccaggatggtgcggaggcgcttttcgttttctctggtggtctcgagctccttctgttttttcgcgactgtctcaaactctggaaggggggcaatgctggggtcgtcctcctcaactcgctccaggggccaggggataccgctcatatcactaagggcggtgcccaggtagaggagctcgcgatagtcccattcaatggacgtgtaccggatgtttaggagaggcagggaggcgatgatctggcatgtgtgccgcaggtgtgtcaggaggtcgtcaaaatccatcaccgttgggaggcttgggtcctcaaggtaggagagataatcggaggccgccgaggccaccttgtccctgatgtccgccgtacacctgcgcacgtgcagggccgcattcttggaccggacgggcacgttgtggacaaaggggggcactgaggcggcgggaggggccccatactctatcgctgtcaacagcgccaaaaagcggacgtcctcctcatctaccccagcctgttgtctggccacggccgttcgggcggcctccgccagggataggaggcgcttccagctctcgtcgtccaggaccaaggggacatccacgtgcgggcccctgtagatggaatgatcctcgggttctcctcctccttcctccccctcctgatctccgcccgagagcaggtcggtcaggcgtctacgggccgcctccaggtcaaattttccgtcgccgctctcggccagctggggaatttcagccagcatcttagcaccggcatctacacggaccgcgtccttcgtggccagggacggcaggcaggcctccagctttgcggccaggtgctcatggaactctcccgctcttcccttgttttctgatagcatgtttgcgaggttttggatgttaagttcggaagtgagcagttgctccaggtccagcgtggggacctgcagatgtcccgaccagtcctttaagaattccagcagatttagcacagccgatcggtccctactccttattagcccctgctcgaggaccactgtcacaagaagatagtctatcatgctcaaggcatctgcctctggcacttccctgttagaggccgggtcgtagacgatggcctgttcctggtaggtatgtccggctattctcgcaatgttgctctcgaggggcacaaagtccatctcaggagtctctatgtcaaaggtggtctgatagtattggctcctggcggtgtccagtgtgatgggggacgtgggggcactggatcccgattccaggctgttggagaacacttcatcttcaaacatgtcttcatcctctgtggtggggatatcggaggctaagtcgctctccgcttcttcagagtcggacatggataggaaaggctcctctaggtcagacaggtagcggacgaggccagaacccccagatgcatcatccccaaaggagggctgctgcccgaagggaggtgatggggatatctccgttccagccctgtcagcggccgagggattgtttttttctggttcgagtgtcgtggctgatggtgggagctgctgagcatgaggaggagccggggtagctgatggcaggggctgctgctgaggaggaagaggagaaggagcccgggcggctgacggcgggggctgctgctgaggaagaagtggagagggagccggggcggctgattgcgggggctgctgctgagttggaggaggagaaggagccggggcggctgattgcgggggctgctgctgagttggaggaggagaaagagtcgtggcggtgggggctgctgctgcagtcggggaaggggatggggtggtcagagggatttctgggttcgagggagctgcctgtggcagagggatgggtatttgcaaagggaggcgaggagatggagtgactgaaggagcgatagttgagactggcgcggggcggggtgtcggggaggcgggtggtgattggtgagggatggggattactggagggggaaggcgagctgctgaaggggggcgatggggcggaacgtgggtgcgtggcagctgatcatcctctgtgtcagtggtggaggacagagggaggcggcggccggaggtgggcttcttgtgggggctatctttgcccaatccctttttcctcttgggagtctgaggcgctgcgccgcccgacgcccttggtggcgtggagggagcggggaccccgggggtgtgacctaggccggggatggggatgaagaggggagggctggaggccggggccgcggaggccggggccgcggaggccggggccgcggaggccggggccgcagaggccggggccgcagaggccggggccgcggaggccggggccgcagaggccggggccgcagaggccggggccgcagaggccggagacgacggcggggagttggtctttgcaggactatacctggcggcagggaatgagtcggatgtgaaagatcgagagggcagtggcctgaggttatacggtattattcgccgttcaaacggtagcatgacgggagggctgctatcagcaccgggcgtccccgccgcctccccatcactggacacaagctcgggccccaccaggtcaaagccgctgccgttggcctcataaaagtcatacacgccatagtgttccagcataaagatgcgggggtcctctgtctcaaaggcctcgggtagaaaatagagatgcacgcaagtgtactgggcccctggtgcccccacgtactgcaggatgtcgtgcgcataggtgctgactctgacatgggcgggggtgcccggggccgcatccttctggcagtgggggtcaaacaagtagaaggagccatctgtctcgatgatgatggcccccgcgtagatgtcgcagatgtagaggatgaactgggccaccccgttgtaactgccgtgcaggacctcggccagggactgaacaactgccgagtttgcgatctgggcagggaataggacgaggccaaagatctccgccgagcggtatatgtgcacgcgcccaccgcccctcaggaccacggagctgggcacgtccgtcaactgggccatctcgtgccccttgaggatgccgctctggcgcatgagggcatccagccgcgccccctcgtccaggacctcgtccagctcagggcgggaggtcagggggcggccggccaggaagctcttgaccaggtagaggacgcagttgctgacgcactggatgccggcaaagcggccaaacttgcagtgggcctggttgcacgaggccgtgcctaggatgcggagggccgagcctccactcccgcccccgggggcattcacatccatggtcctgattccgcgcacggggccggttccccgggtgcgctggctttgcccccagtcgccgttactcatcttcggcggtggggcggggaggacgccttgtcgccccccttctggtccggggtcttacgcggctggcggcggcagccgccgagagataaggggggtacgtgtgtgcctccgcctctcctctgtctgggccgccgccgccgcttgcccgccttgaaggagagggggtagtccgcggactgcgtctgcgggggcaggaggtctcaaccttctgggctcgggccgcggtgtcgatatccgatggcctttccctgtcttcctcgtatgctccttctcctcctcctcccggcacgcccctgagatctgcctcccctccctctccctcgtcctggtcggaaaagtctgaggaggagaaggagaatggggaggagtccaaaacggcacgccacctgccgtggggcggtggtgacaggtcccggctggcccggcgcttgctcgcgttcctgccgttacccaggagaatggccgcgagttttttggcggggaggatgcggaatggcgggggcgtttgtcccacgggtgagggggaatcgtcggttagggccggcacgaggtggtgggtctggacccgggccgtgcgagcaaaggcggcgagaaccgaggggcttctgggggtgactgtgatctgttccggatttaggtccatggcgggtgtgtatgttttaataggggtggtctctggcgcggcaggatgatggtcgaggacgtccaccagggccttgcagatgctcttgcctagatacaggatgtcgtccatgctgaggggaggtggggtgtctgctcccccctgcggaagccgcctgggtgcgggggtgaagacaggtggtgggcgggcgtctcgccggactatggcctcggcacgctcggcgtcgatggcgggtggctggaacaggcgggcgaatgtgtaatcccggaaccggtaggcgacgctgcgcctgagggcgcccgtcaggctgtatcccagctccagggcgtgctccacccgctcgttgagctcctcgagatccggacgcaggggctcgctggtgtgggcccagagggggtgatccgcgatgccccggctctccctgagggccggcaccaggaggcgccttctgagggtggccgtgtcggccgtggccagggcccacctggcggcggcgtcccggcacacatcctggatgccctccacgacgctctttagcgtctggaggtccgtggagtagtggcggggggaggatgaaacgctcttttccttcaccgctaccaccgcctcctcctcctcttccgtcgccagagggatctgcaccctcccggtctctgcgtcgtacaggagcgggcgggagcacagcctccaagctgcccccgtcaagcgcgagatgtcctccgagagggtctcacccgagaccagaaagcggcgggtggccaggcccaacgactccgccgtcgtgctgtatctcagggtgaagaggagtgaaaagagggaggtgggccaggcaagcggtggtgcttccgccgcccgctctgaagctgagatagtctcggagatgatgcctgagacctctcggacggcgtccatgatcctaaggactgcgtcgtgggacgacagcccccaggggcccccgccctcttcgtcttctgcaccctcggctcctgcgtccccggccttgccttccccctctaagttgagggggcgcagtccgaccgcctggggggactccccaggcatcggaggggccccgtcatagatctcccagacggtggcgtatatgagctcgagaggacggcgggcccgggtcagctcgggggaagggagggccaggtcgctgccgaaggagaccagccagcgcagggcggccagagagcgggttttgggcagctcgttggagaggacccggcgaagggcgggccagatttggaactcgatgaaggcggccgggaagaaggggctgcggacataggccggatccgcgcgcgccgtttggccggccctcagggaccggcagtatgcctcgacgtctgtccgcggggccgccgccaccgccgccgtccactgccttctcccctgctcgccggggagtagggggggcttacaggggagggccggagccggggccggggcctgccacaggcggctgtagcggacccatagcagagacctgaggagttcggatgaaaggtcccccgccacctgctcatactcggccgcgggaggagggacgatgaagatgcgcagaggggttacggcgtcccaagggtccgccgccgcccccacacccacagccgtcgcggcgggggcggcggcgggcgtagaggggccgctggtgcgccgggctcgtctgtccacggcctcggcctccgccctcaggtaggccgcccgggccacacgggcgaagcggctcgtggggctcgcggtgggcagcagtcggaaaaagtgcagggcaaagcccgatagactctctaggagggcggcggtggcctcgagccacctccaccgcgagcgggacacccggggcacagaggccagcatcatggcgtagtcccccgccacggtctcgttgagcccggccgagagcagaaccgtggccacctgctcgatggcggctggagagaaggatgcccggctccccgccgcctcctgcacacgagcggccagggcctccatctctgccgccatcccggccaggaaggcctcgatgaccgagtctgggacgccgtaagtctggtcccagagcagggcctcgtacacatagtcgtaaaagagggcccctgagggctccaaaagccggagccgggcggcgtcaaaggccaggacgggcacagccgcgacggggggcgtttgtcccccgctggcctccgcgtacacgcccaggatctctaccgcccgccgccgggccaggggcagtgaggccaccacgctggaaagtgactcggggcggtgaaagagaccgccaccgccgctttcttcaccctctcccccgccggccccgcccccactgtgctccaccagctccacggccatggccttgatgtccgcggccgtgggctgaccctgccctgcagccgcccaggggtagcggttggtctccgcgtatacggtgaccagccatctccccagcgtcgttttcgccgcgttaaaagcgtagaatgacagcccctcccgcgggaaggcgtcccaccgggccagataagtgtcggccaccagctcttccacgaaggcaaaggtggccgttgggccagagaccgcgagcacctccccgctgccctcttcgatgatgcgccggtacgtggccgccagggcccgggtctctgcgatgagccgagagccgtccagcggatcgtcggtggccggagaggctgtcgtggggggcagtgaggaggccagcacgtccagggccgcctccagatggccgaggccgaagctgcgcctggaaaaggaggccgcccggagtaggtagtaggcgtggtggcggaggaccgccgccgggtaagcgtggccgctcatgagggtgagagtatttaaaaaatcgcgcaccagcaccggctgggccaaatctcccagtccaaagatccccagctccagaggcatcagcgcgcgcaggcgggcagcggggtcgtccccagacagcagcaactgacgcgtcacgcgggcgagccccccgtccacctctgccaggggcggctgggcgtctgcccctccgctaccgccgccgctgtcactctccatagcggacgccatgaaggtccaggggtccgtcgatcgccgccgtctgcaacgccgaatcgcggggctgctgccccctccggcccggcgtctaaatatttcccgggggtccgaattcacgcgggacgttcgtgggctggttgaggaacacgcgcaggcctcctcgctgagtgcggcggccgtctggcgcgcagggctgctggccccgggggaggtggcggtcgccgggggtggcagtggaggggggagcttcagctggtctgggtggcggccgccagtctttggggactttctgatacacgccagctccttcaacaacgccgaggcaactggaacgccccttttccaattcaagcagagtgacccgttctcgggcgtcgacgcggtattcactcctctctccctgtttatcctaatgaatcacggccggggtgtagccgcccgggtcgaggcaggtgggggcctgacgcggatggccaacctgctgtacgacagccccgcaaccctggctgacctggtcccggactttgggcggctggtggccgaccgccgcttccacaacttcatcacccctgtgggccccctggtggagaatataaagagcacctatctgaataaaatcaccacggtggtccacgggcctgtggtcagcaaggccatccctcgcagcaccgtcaaggtgacggtgccccaggaggcctttgtggatctggacgcgtggctctccggcggcgccgggggtggcggtggaggatgcttcgtcggggggctgggcctgcagccgtgccccgccgatgcgcgcctctatgtcgctctgacctatgaggaagccgggccgcggtttacgtttttccagtcgtcccgcggccactgtcagatcatgaatatcttaagaatttattactcaccatccatcatgcaccgctacgctgtggtccagcccctacatatagaggagctgaccttcggggcggttgcctgtctggggacatttagtgctactgacggttggaggaggtctgccttcaattaccgtggctctagcctccccgtggtggagattgacagcttttattccaacgtctctgactgggaggtgattctctagacttaacgggaggaaacaggaggaggagggggacaagagcacaaaagtggttcagtggacacccaccacacagcatggcaacgaccagtcatgttgagcatgagctcctctccaaattgattgatgagttaaaggtcaaggccaactcagaccccgaggctgatgtcctggcagggcgcctgctccaccgccttaaggccgagtcagttacacacacagtagccgaatatctggaggtcttctctgacaaattctacgatgaggaattcttccagatgcaccgggatgagctggagacccgagtctctgctttcgcgcagagcccggcctacgagcgcatcgtctccagcggctacctgtcggccctgcgctactatgacacctatctgtatgtggggcgcagcgggaagcaggagagtgtgcagcacttttacatgcggttagccggcttctgtgcctcaaccacctgcctctacgcgggtctcagggcagccctgcagcgggccaggccggagattgagagtgacatggaggtgtttgattactactttgagcacctaacctcccagacggtgtgctgctccacgccctttatgcgctttgccggggtggaaaactccactctggccagctgcatcctcaccacccccgacctcagctccgagtgggacgtgacccaggccctctataggcacctggggcgctacctctttcagcgagccggggtgggtgtaggggtgacgggggctggccaggatgggaaacacatcagcctcctgatgaggatgatcaacagccacgtggagtaccacaactacggctgcaagcggccggtcagcgtggcggcctacatggagccctggcacagccagattttcaagtttttggaaacgaagctgccggagaaccacgagaggtgcccgggcatctttacggggctctttgtccccgagctcttcttcaagctttttagggacactccctggtcggactggtacctgtttgaccccaaggacgccggggacctggagaggctctacggggaggagtttgagcgcgagtactatcggctggtgacagcgggcaagttttgtgggcgggtctccatcaagtccctgatgttctctatcgtcaactgcgccgtcaaggccggcagccccttcatccttttgaaggaggcctgcaacgcccacttttggcgcgacctgcagggcgaggccatgaacgctgccaacctgtgcgccgaggtgctgcagccctcgaggaagtctgtggccacctgcaatctggccaacatctgcctcccgcgctgcctggtgaatgcgcctctggcggtgcgggcacagcgggccgacacgcagggggatgaactcctgctggccctccctcgactctcagtcaccctacctggagagggggcagtcggtgatggattctcgctagcccgcctcagagatgccacccagtgtgccacctttgtggtggcctgctccattcttcagggatcccccacttatgattccagggatatggcctccatgggcctcggggtgcagggcctggccgatgtctttgcggacctgggctggcagtacactgaccctccctctcgctcgttaaacaaggaaatattcgaacatatgtactttacggccctctgcaccagtagtctgattggacttcacaccaggaagatttttccgggtttcaaacagagcaagtatgccggggggtggtttcactggcacgattgggcaggaacagacctttctattcccagggaaatttggtctcgcctctctgaacgcattgtgagggatgggcttttcaattcacagtttatcgccctgatgcccacctcaggctgtgcccaggtgacgggctgttcggacgccttctaccccttctatgccaatgcgtccaccaaggtcaccaacaaggaggaggcccttaggccaaaccggtctttttggcgtcatgtgcgtctggatgacagggaagctttgaatcttgtcgggggccgtgtctcctgcctcccggaggctctgcggcagcgctacctgcgtttccaaacggcctttgattacaaccaggaggacctgattcagatgtcccgggacagggccccctttgtggaccagagccaatctcacagcctgtttttgcgtgaggaagatgccgcgcgggccagcacgctagccaacctactggtgcgcagctacgagctgggcctgaagactatcatgtactattgtcgcattgagaaggccgccgatctgggggtgatggagtgtaaggccagcgcggctctgtcggtgccgcgggaggaacagaatgagcggagtcccgctgagcagatgccgcctcgtcccatggaaccggcgcaggttgcggggccggttgacatcatgagcaagggcccaggggagggaccaggtgggtggtgtgtgcccgggggattggaagtgtgctataagtaccgtcagctcttctcagaggatgatctgttggagactgacggttttactgaacgagcctgtgaatcttgccaataaacgtttattgccatgtccaagttgttgtacgtgcgtgatcatgagggctttgcctgcctaacggtcgaaacccaccgcaaccgctggttcgcggctcacattgtcctcaccaaggactgcgggtgtctcaagctactcaatgagagggacttggagttttacaagttcctctttacgttcctggccatggccgagaagcttgtgaactttaacattgatgaactggtcaccagcttcgagagccacgacattgatcactactacaccgagcagaaggccatggagaacgtccacggggagacttatgctaacattttaaacatgctctttgatggggacagggcggcgatgaacgcctacgcagaggccatcatggccgacgaggccctgcaagccaagatttcctggctccgtgacaaggtggcggccgccgtcaccctgccggagaagattcttgtgttcctgctgattgaaggcatcttcttcattagctccttctacagcatagccctgctgcgggtccggggcctaatgcctggcatctgcctggccaataactacataagtagggatgagctgctccacacccgcgctgcctccctgttatacaatagcatgacagccaaggctgaccgaccaagggccacctggatccaggagctgtttcgcactgcggtggaggtagagactgccttcatcgaggctcgtggagagggggttaccttggtggatgtgcgagccataaagcagtttctggaggccacggccgatcgcatcctgggtgacattggtcaggctcccttgtatggcacaccaccccccaaggactgcccgctcacctacatgactagcatcaagcaaactaatttctttgagcaagagagttccgattacaccatgctggtggtagatgacctttgagtcagggtggctacttgctcaggtttctgggcataaattctcctgcctgcctctgctctggtacgttggcttctgctgctgcttgtgatcatggaaaccactcagactctccgctttaagaccaaggccctagccgtcctgtccaagtgctatgaccatgcccagactcatctcaagggaggagtgctgcaggtaaaccttctgtctgtaaactatggaggcccccggctggccgccgtggccaacgcaggcacggccgggctaatcagcttcgaggtctcccctgacgctgtggccgagtggcagaatcaccagagcccagaggaggccccggccgccgtgtcatttagaaaccttgcctacgggcgcacctgtgtcctgggcaaggagctgtttggctcggctgtggagcaggcttccctgcaattttacaagcggccacaagggggttcccggcctgaatttgttaagctcactatggaatatgatgataaggtgtccaagagccaccacacctgcgccctgatgccctatatgcccccggccagcgacaggctgaggaacgagcagatgattgggcaggtgctgttgatgcccaagacggcttcctcgttgcagaagtgggcacgccagcaaggctcaggcggcgttaaggtgacactcaatccggatctctacgtcaccacgtatacttctggggaggcctgcctcaccctagactacaagcctctgagtgtggggccatacgaggccttcactggccctgtggccaaggctcaggacgtgggggccgttgaggcccacgttgtctgctcggtagcagcggactcgctggcggcggcgcttagcctctgccgcattccggccgttagcgtgccaatcttgaggttttacaggtctggcatcatagctgtggtggccggcctgctgacgtcagcgggggacctgccgttggatcttagtgttattttatttaaccacgcctccgaagaggcggccgccagtacggcctctgagccagaagataaaagtccccgggtgcaaccactgggcacaggactccaacaacgccccagacatacggtcagtccatctccttcacctccgccacctcctaggacccctacttgggagagtccggcaaggccagagacaccctcgcctgccattcccagccactccagcaacaccgcactggagaggcctctggctgttcagctcgcgaggaaaaggacatcgtcggaggccaggcagaagcagaagcaccccaagaaagtgaagcaggcctttaaccccctcatttaacaccatgttctcgtgcaagcagcacctgtccctgggggcctgtgtcttctgtctcggcctcctggccagcacccccttcatttggtgctttgtctttgccaacctgctctctctggagatcttctcaccgtggcagacacacgtgtacaggcttggattcccgacggcatgcctaatggccgtcctctggacgctggtacccgccaagcacgcggtgagggccgtcactccagccatcatgctgaatattgccagcgccttgatcttcttctcccttagagtctactcgaccagcacgtgggtttctgccccctgtctctttctggccaacctgcctctcttatgcctgtggccccggctggccatcgagattgtttacatctgcccggctatacaccaaaggttctttgaacttgggttgctcttggcctgcaccatctttgccctgtccgtggtctccagggccctggaggtgtcggctgtcttcatgtctccatttttcatctttctggctttgggctctggaagcctggccggtgctcggcgtaaccagatttacacctcgggtctcgagcggagacgcagcattttctgcgcccggggagatcattcggtggcatccctgaaggagaccctccataaatgcccgtgggatctgctggccatctctgccttgaccgttcttgtcgtctgtgtgatgattgtgttgcatgtgcacgcagaggtgttctttggactctctagatacctgcccctctttctctgtggggcgatggcctccggggggctgtacctgggccattccagcatcattgcatgtgtcatggccaccctctgcaccctgtcatctgttgtggtatatttcctccatgaaacccttggacccctgggcaagaccgtgctgtttatctcaatctttgtctattactttagcggggtagcggccctgagcgcagctatgcgctacaagcttaagaagtttgtgaacggacccctggtccatctccgtgtggtatacatgtgctgttttgtctttactttttgtgaatatctgttggtgacattcattaaatcctaacgaccggagtcctgtctctttgtgttcttgggggacttgagttagctgtctttcctcttattacattgggctaacgggaggaaatgaacccaggggtggcagtggatggggtcatttatgggcaaaactcacaggacatgtttggggagttagcattggcgtcgggaaacacagctctggcagttataaccgcaccagctaacaggacatgtttgggggagttggcattggcgtcaggagacacggctctgtcagttatcaccgtaccatgagtgccatgtgtgtccagtgcctaatcaccgttcctcattttgtgtgcctcctcaaatgttccagaagtcggccacaggggaggtggctgaattagggccttttccctcattcccccatgagacccacgtggcaggcctaggggctacattcgcctcccacgtttcccttcgcgtgaggcatccgatatgactgaattttcgcagtctcttttccctcttcccttgttattcccatagaattacagtgaggttacacaggtggagattcagtttaaccatttattgatttaatccaggaacaaaaaacagtcctagtgacccagtgcccggagagagaatggccctgacaagtcggctgcatgatgcacttcggcagtcacgtgtgtgagtctccacggcctctgtcaaaagggagcttagcgtgccagggttgtaattcttgatgtagtggcccaggaattcaacttcatcgtgtctccgtctgcagttggcgttaatgtaggctggggctactgccgcatatgctgccaagagacagaggggctgcttcacatatgagctgctcagggtctccaccaccttgttttgacgggccgtggcacaggtgatgtagaagagttgcttcacaaagttgtagtctcgcgtgttaggaaggaagcagggtgccagctctttgagcttggtcaggatcaccttgctaagactcatggcgcaggccaggaggatgtcttccgcgggagctaggggcaggtcgccgtggtaggtgatctcctggagccaaaagatggtctcttctagcatggccaccagggtgcagagccccgcgttctggatcgcctgcatgcgtgcatccagccatgtgtccttgttggttgacttggtgaaaaactcacgtagtgtcttgtagctcctgcgcagctcgtgtctgggttgcactttctgccaggctccaatctctggatgggcggccaccgccagcatcgactgtaggaacgggtcttggatgggctctagggtcagagaggccagggggctgggcaaggtgacaaatgtaatcttggagacaggcttaaccagactcatgtcaaaccacggtttgttgggcaggggcctctggctgcgttcttgcctcgcctgcttccttgtgctcctgccggcccctcgagattctgaccggggacctctggttgctctgttgcttcggggagctcttggagacctcggtgctctaggcaccctgggggcccttggggctctgggcgctcttgctcccgggggcaggtgtcggcgcttgccataactttcatcggtgcagccatggacctctccgcgtcgccttttgtggcctctggtgtaagaggagttgccagtctcctccttctcgtcctcgtccctgcacaggggtgagcgatgcaatgtgactgtcttgtcctgtaggtcccacttctttctgggaatcacaaacgatgccgaggtaggggttatgaccacgctggagggccgtgcaggtatggtgtgggccggagttggatcttcatcctcctcctctgaggatgaaatctctccatctgtggagtgttcttcgctgccctccatagggtccatatcgcagtctgtgttggtgtctgagaccgcttcgagttccagaatgtggctctctgcagaggggagacaaaaggtggagactgccttgagcacctctgtctcaggcaccggatgcccccggctccacggccccggccactggccggtgtagcttcttacctgcgggatcctcgttggaggaaatgctgctagttcgggagagtctctgagaaggaaccatcttgtctgtctctacgacgggctagctgggatgtagtgctgtcttgactggcctcagccctatttatgattctggaggcgggcacgctgatggagaaatgggcggtcggttgattggccccacagcgaccggcgaagcactgactcatgaaggtgaccgtgatggcctgtgatgtgtagtagagtaccagaaacaccctcacattcttggagctggccctgtgggtatgcctcaggcacgcaaagttcctgccccgggcatggcacacctgaactaagtttggcccggtttgctcaaacgtgacatggagaaactgggggaatttgtcttctggcacagctgttgccagggtgctcatgagcgagggccagatgcaggagctgacccaggcgacgagatccaggcccagatgtccctctatcatggcgcagacattctccacggtggggggcagggtctcgcgggtcctctggattagatagtcacgcccatcatccgcgatgtggtagcagaaggttttgggggccggccagcccacgtgcagtgagtgatgtaagaggttttgaatgttgagggcattcttaacatagctgtgcttgtcttcctcttccggatgacagacaaagaggcgcagctgccggctaagaccaccgcccctgtccaccttgtaggtatgcggcagccggatgcaccgcccggcgtgatacacgccgctgtcaaaaagcggggccccaatctctttgatcttgtgacgcatgcggcgcaggcaggccgttaggcccatgagcttctgcagcacagacacaaacccttgtactgcgcttgttcccacaatagcatggcctctaggtaggggggtgatgacgcgaaagcccagttttcccgtgcatatgcaaaaggggagcacatcttccatattatccgggtcggcgggtggacaagctgatttgaaaaaatagactgggtgggccctggacactggacccaggcggcgcatgaggcgcagtacctcacgccgcacggtccggcacaggtcatagatttcctccagcgaccagggggcccccttgatctttagatccaggtccaggaccaggttgcagaccggaagccggggattaaagtattcatgccgggagacaaagagctgctcgctcaggctgttctgtgaatagtacactggggtgtaggagagggccctggtgagacacgtgtctgggaggcggcagttggtcggggtggagacgacctccgccaggtgggacgagaaggggtcagcggctgtcattacaaagtagtgcctgtctgcaaaatggcagaggaagaccggtagccgctgcacccttcgaaggacggtgggtgggaggaattgttccttgggattccactggccccggcaggtggcctggccggccaagcatagaaacccttgaagcgtgggggggtatgtgggaccctcatccgcgtgccagcgcgcgagctccaccagctcccgggccacgtccacactgagcccggcccaagcccgcatgagtccgtcatcggggtcggggtcccacgtgtatggggccgggggctccatgcggattttcagctgctggacacgcacatgctcagccaggtaagtctcccgggtgaagtaggtgcgcatgtgctccgcaaagcccctgtccaggagcgaggggagcacgacgccccccgaaggcagacacccaatttctcccacgctcgttaactgagagtatcgcttaaaggttccctcgttgaagcactgtgcgtgggccaaatagacgtagcgcacgagatcggccgaggccaggggaaggcgccccctgtaggcgtctatcgtccttgccacagcgcggatctctcgtgagtcccgccgcagcttctcgtgtgcaaagtgggcaaaagcctcggtctgctccgcccatgccgaggagccaaagacctcccccagctcggccagggacgtgacggcggccaggctctgaccagactcggaagtaaatagctccgtgaggtgcgccagggtctcaatcgtacaaggaatgccccaaaaatagtaagcagccgtgactagcacgaactgggcctcgtgggagccaaaggtgctaatgaaccacctggccgagatgttaacgcggtagatgcggcgcagacagcccacgatcttgggacgcagccacgccacgcggcctctggcatccccctgtggctgcttcttagcgctcagtgtgagcagttccacgaggggcgtgagcgagcgcagggcccccgcgcgatctaggtaggtggatagacggtccgcggtgagcggcgtgaggccgcgcaggaaggggaaggcctcctccgccggcaggtgcagcgtcagaaccaggccgcagcggctctgtgaggtcagccgcttcttgggcaggtgaagctgcagttccacgagagaacccgccacgtggtggaggggcgaggcgttgtggcacaaacaaaacaggcggaagccctcgtcaggccgcgagaggatggcatcgaggatggcctccgcaatgtcagtgtttgaggccacaagggccttgatgacgacgggggcggacattatttaagaccgggaggccccaacggcgggctaaacagaacgatggccttctatctcccagactggtcgtgctgcgggctctggctctttggccggcccaggaatagatacagccagctccctgaggagccggagacctttgagtgcccggaccgctggcgagccgagatagatctgggcctgccccctggtgtgcaggtgggagatttgctaagaaatgagcagacgatgggctcactgagacaggtttatttgctcgccgttcaagccaatagcatcacggatcacctgaagcgctttgacgccgtccgcgtccctgagagctgtcgtggggtggtggaggcccaggtggccaagcttgaggccgtgcgctcagtcatctggaataccatgatctctctggctgtaagcggcatcgagatggacgagaatgggctcaaggccctgctggacaaacaggctggcgacagcctggccctgatggagatggagaaggtggccacggcgctcaagatggacgagaccggtgcctgggcgcaagagatctcggccgttgtctcatcggtgaccgccccctcagcctcggcccctttcatcaactccgcctttgagcccgaggtgcccacccccgtccttgcaccgcctcccgtggtgcggcagccggagcactctgggcccacggagctcgcgttaacgtagcaaccagactccacaccaaataaacattttattggtaaaacaagggatatgaaggtgtcattgacccgaggatccaaaccccctcccctgtctcccctcgagcgcctcgctcagcccactatcacccatggccaggcccggcacctcctcgaaggcgcagctggcccacctaaagagagatctggggccaaggacccccgcgtcactgtgggggctgtagaaggaggtgaggtggtgcttgtgaaggtaaacaagctgacagaagcgccggtacttgttaaggaacacggtctggtcactaaagttggtcaggctgacgtccaccccaccccggcgccacctgcagggcttcactagaataccctgcatggccaggcccgacctgccaaagattgtcggcctgtggtgagggatagaaggggggggcacggtgagtgtcactgagacggtctgatgggggaagagggccaggtcctttggcaaagagacgtccaggcccacgtccccggggtactgggggtggttgatgggacccttgtcctcctccatctggggggtggcatatctgaaggcagccaggtggattttgagctccgatggacgcagcgtggagttgtagcgccgctgattctggaggattagccggagttcccccgtgtagccgggatcgatgatgccaacatgagacgtgaccggacgggaggtgctgccccacagcatgagcccatgaccctcgggtgggcgggcatagaggcctaggtccacagttgtggtcttcatcgggcgcagcaggatggtggtcttgttgaccaaggtgagccgccctacactagcctgctggagcaacagcttgtcattctggaaggcgtagcgtatgtgtggacaggcctccatggtgatgatctaacagacagggacggcggcgctatatataagagcccaagacccggctctctttactgcgaaatggggaaggtcctaagaaagccgtttgcaaaggctgtgccactgctcttcctcgccgccacctggcttctgaccggggtgctgccggccggcgcttccagtcccacaaacgcggcggcggcttccctgactgaagcccaggaccagttctactcctacacatgtaatgcggacacattctcgccttctttgaccagctttgcctccatctgggcacttctgacgcttgtcttagtcattatagcctcagccatctacctgatgtacgtctgctttaacaagtttgtgaacacgctgctgacggattagatggggatatttaaaaggggcagcaatctcggctgtctgtacttcttctctgctcgttaaaccaatagcatgtcagctccacgcaaagtcagattgccttctgttaaggctgttgacatgagcatggaagacatggccgcccgcctggctcgcctggagtctgagaataaggctctgaagcaacaggtcctcagggggggtgcctgtgcctcgtctacctctgttccttctgctccagtgcctccgcctgagccgcttacagctcgacagcgagaggtaatgattacgcaggccacgggccgtttggcgtctcaggctatgaagaagattgaagacaaggtgcggaaatcagttgacggtgtaactacccgcaatgaaatggaaaatatattgcaaaatctgaccctccgcattcaagtatctatgttgggtgcaaaaggccaacccagccctggtgagggaacacgaccacgagaatcaaacgaccctaacgccacccgacgtgcccgctcccgctcccggggacgtgaagcaaagaaagtgcaaatttctgattaataaatctttattgactttatacataggtctcggcgtcatcatatggtggggtggtgtaggtatgggatgtcgacaagttacgcctgaaggcgcagtccgccatgaccagcagcagcagaagggtcagcacagccagagaggcccactgcagtactagcatggagaggtttgagaatctgggctgggacgttggcgggacaggcacggtggcttgggctgtggtaaccggtgggctcgtaaaagtccagcggggccgcagtttgctagaagtgctgggaggtagataggtggtcgcattgtatctcgttcttggcgtagttgaatcaccgccgtaatctgtggtgggctctgtacttgtccgggctccatgtcctgtggtgtgctttccaccggtggtagaattggcctttccacctgttgaggtgaccgtgggaaccgccgtcttttggccactgggggcctggggcgacgttgcatttttggggggcgtgcctttggtgacattaacctcccccggttttgtggatgtggaactgtttccagggcctgacgcttggctggtggtgcctgggcggggcgctggcgaactggtggacacatgatgtgtgctggtagaggctggtgtcacctgtgttatattttcaccacctgttgggtgagcggaggttagtaaaggcatatgtgacgttgaattgtcactggtggaggggctgagtgtctctgagattgaactgggtctcagtgacatggaagaggttgaacttgaagttatgttatgttggcctgtggtaacagcactggttgcattttttggtgggctggtaactactggggtggaacttgttcctcctaatgtgtggttggtggtatttgcctgtggacttgtttctcccacggtagggctggtggcatttggggttggggtagtcactgctgaggtgggacttgtttttcccaaggtggggatggtggcatttggggttggggtagtcactgctggggtggggctggtggcatttggggttggggtagtcactgctgaggtgggacttgtttttcccaaggtggggctggtggcatttggggttggggtagtcactgctggggtggggctggtggcatttggggttggggtagtcactgctgaggtggggctggtcatgtcgggggccttactttctgtgccgttgtcccgtggagatggacttggtgtcaccggtgatgcgcctgacgttgtgccggctggtgttgggctggtgacatccgcggtggatacagtggggcctgtgcttgcaggtgcggtgaggttggtaggcacgtgagtagagctgggtagacctgtcgttgtattgggagcagcaaatccagttgtattcaaggtaggggaggtggtggtgctctcgggtgccttggagaatataaccttgtgggttgttgtggtggcattggtagccgttcgtgtgataatgagtgtcttgggggccgtgccaagacccgagacagtaatgtcaaatgtccgattgctcgcaaatgcaccagaaatattttcacaacccgaaggtgtccccgaggtgagagtccatttgcacttaaagtcagtttcagtgttgtttggccaggcccaaaaggcagtcactgtaacatttggcgagtttgcgtcctcagaagtgaccattggcactgaataggtagcattgtcacccacatatgtgatgtctgtggtgtttgtcggcatgtcctgtgaagctggaatctcatcagagaacacaatgttggactgaatgcagtaatctcccccgctcgccttcggtccattcccagagtaaaacacgtacagtatactgttattgccaagaaatcgtgacactggacgtggtgtcagacgcaggctgtatgcataccctgtaccaggtattggggtggccacgggactcgttgatgtgagaattccgccgctgggaacatggctctcgtatccactgcaggtgatgttaaatttgttgtctccgggcagaacttgtgaaatttcgccatcctccataatacactcaatatctatctcattaccgagcatttctgtttttacgctgaaattcgagtcttgagctgatgttggcaaacttaagggtagcgtgacatccagcccctgtgcccttactactgccgttatattggtagaattacagttatcccactttatgtatggcactgtttctggtattaggtatactgggttttgcatttctgcatggtggcaccacatggtgccaaacacatcttgaaagtagacatctacagattccaggcttacttgttgctcctctccggtggtgatgttaattggaagcttcttagaccgcatagttagagccaattctcctgcaccaaggagctccagtagaaagagattggtggcattttctgagccaccaaatgcacctcgaggttggtagacagcctttgtatggggtgtcagcaggccaaagtcaagattaagtttatgctttttgcccccgacatcgaaattgatagttgcattgacatctgccgtgcaaacattgcacgctgggtaaaatgggaattccagaatctcaacattgaaaaaaccaggatcatcacgcgtgagttggataaggctctggatggtgtactgacacacaagcaaggctgcctccattgtctcagcaccgatttctaggcagcaccctctttaataggtgcaaggggggtgcggtgttggtgagtcacactttcgttgcagacaaaatggacaaggacaggccgggtctcccggccccggatgacaacatagaagaagtaccatctacctcgggtgttcaggaacgggcgtctgagggagattgggaaaatgtcctcatagagatatcagatagcagctcagaagaggaagcagaagatgcccacctggagccatcccagaggggtaaaaagagaaaacgggtcgatgatgatgccggtggttcagctccagcacaacacgtgcccccccctcagctggatcaccctggtcgagaagccattctctacaggtttccgctagatttaagaaggtttattcaagcaattggagccgcagctacggtgagcttccctatggcccaggtgtgtgatgtgtgtttttgcccatcgcacaacaaggtaagtgatttgttgccgttggtttcagcaccccgacacgcgagccatagaccagtttttcggatcccagatttcaaataccgacctgtacgtaatgtatgccatggccattcgacaggccattagagatcgtcggaggaatccagcttctcgtagaagtcaggtcaaatggagaatgaccaccctggccgctggttggcctatgggttaccaggcatacagtagctggatgtacagctacaccgatccccaggtgactgccacgatcatacatctgcaggcgactcttgggtgcgcaagtggccgtaggtgtcatgtgaccttttctgccggcacctttaggccgccgcgatgtagtcccggggatcgccagtggttgtatgttcagagccgcgtgggtgaccttgtgcagagttctaatccatgctacagtattttctttgactacatggccatacataggagcctcacgaaaatctgggatgaagtggtaacacctgatcagcgtgttacatttatggaattcctgggctttttgcaacgcacggagttggtctacatcaagagctttgtcagctatgccttgggcaccactagtatcgaaacaccgtggatggatgagaatcctagcacagagacggcacaggcttggaatgccggcttgctccgggggcgtgcgtacgggcaagacttgcttagaactgaaggagaacatggcgaaggtgctacctgtgaaacacgggaagaaagtgaggacacagagagcgatggggatgatgaagaacttcctcgtgtagtgtccagggatggaactaagcacagacgaccccctatatttttaagacgcctgcacaggttgctgttgatgagagcgggcaaaggaaaggaacgggccagggagacactggcgaaggcccctaggcgcacttatggcacacctaggccgccagttcagaaaccaagaccagaggtcccgcaaagctatgagacagctaccagtcacgggtcggcgcaagtcccagaacccccacccacccacccattacatcagcaacacagcatggccccgtgtatggtagctcagaacccacgtgcacccttaggggaccaactcccaggtgttcctaaagatggacgaggggcgtgtgcaccggtacccgccctggccgggcctattgtccggccctgggagtcatccctgttacagtctccgggaagggcctttgcacccgttagcccacaacccatgccagtagaacccgtccctgtccctactgtggcacttgagcgaccagtttgtcccgcacctcctgagattgctatgcagggcccgggggaaccttctggcattaaacgcacacgggagcgttggaggcccgcaccgtggacgccaaacccaccccgctctcccagtcagatgtccgtgcgtgaccgtctggctcgtttgcgtgctgaggcacaggcccgtcaggctagtgttgaggtgcagcccacccagttgacccaagtatcccctcagcaaccaatggagaggccgttggaaccagagcagcagatgttccctggttccccctttagccaggtcgctgatgttgcccgggaatctggggtacctgcaatgcagcctcagtactttgacctccccttaactcaacccattagccagggggcacccgcggccccgttgagggctagtatgggcccggtacctccggtaccggcaacacagccacagtattttgacatccccttaactgaacccattaaccagggggcatccgcggcccattttctccctcagcaaccaatggaggggccgttggtacccgagcggtggatgttccaaggtgccaccctgagccagagtgttaggccaggggtagcgcagtcacaatattttgacctccccttaactcaacccattaaccatggggcacccgcagcccatttcctccatcagccaccaatggaggggccgtgggtacccgagcagtggatgttccaaggtgccccccctagccaaggcactgacgtggtccaacatcagctggatgatttggggtatccactccatgatctcaaccatcccggggttcccgtgtctcctgccgttaaccaatatcatttcagccaggctgcctttgggttacctattgatgaggatgagagtggcgagaggtccgatacctccgagccgtatgaagctcttgatttgtcaatccatggcaggccctgccctcaggcccccgaatggcctgttcaaggggagggtggccaggatgccaccgaggttcttgatttgtcaatccatggcaggccccgccctcggacccccgagtggcctgttcaaggggagagtggccagaatgtcacagaccatgaacctagaagggtggtggtgtcagctattgttcacatgtgtcaggatgacgagtttccggatctacaagatcctccagatgaggcctaagcaaaggtgtagaagtgtgtccccctccattccacccactgatatacgcccgacaataaagttgatgatattgaattccacacctactcgtgtttgtgattttatttcatattccatgagagagacctcgcatatttgcagagggtcactgaaacattttatcttaaaacagttacacctgaaaaatgaagaaagcgtggctcagcagagcacagcaagccgatgccgggggggcatctggctccgaggacccaccagattatggagatcaaggtaatgtgcaacaggtgggatctgatcctatttcacctgcgattggcccctttgaactctctgcggccagtgaggatgatcctcaatctgggccagtggaagagaatttagatgccgctgcaagagaggaagaggaacctgatgagcaggagcacaatggtggtgatgatcccttggaagtccatactcggcagcctagatttgtggatgtgaacccaacgcaggctccagtgatccaactagtccatgctgtttatgattccatgttggtaagaggcacctagaacatttccagatgtttagcttggatattttggccagtcttaatttattgtcattggtttcagcaatcggacctccggtctctaggcagtttattccttgagcaaaacctgaacatcgaagagtttatatggatgtgcatgacagtgcgtcacagatgtcaggccatcagacaaaaaccattaccgattgataagcagaggcggtggaagctcctgtcaccttacagaacctggcgtatgggttaccgtacgcaaaccctcaatgtaaacagttttgagacagggggagataaagtccacccactccttgtgactgctacgctaggatgtgaagagggcctgcggcatgcaataacttacagtgctggcattgtacagctaccacgaatgtcagaccaaaaccaaaagatagaaacagccttcttgatggcacgtcgtgctaggtcactttcggcagaaagatatactttgttctttgatttagtatcctctggaaacaccctgtatgccatatggattgggctgggcacgagaaaccgagttgcatttgtcgagtttgtaggatggctatgtaagaaggaccacactcatatacgtgaatggttccgccagtgcaccgggagaccctcaccatccaagccatggatgagagcgcatcccgtcgccgttccttatgacgatccattaacaagtgaggagactgacctggcctatgcccgtggactggccatgagtatcgaggctgctagactgccagatgatccaataattgttgaggatgacgatgaaagtgaggaaattgaagataaatgtgataaggatgaagaggaaagtggaacggaagatgttacaagcataccgcaaacactgccgcacagtccaacagtatacggcaggccctcggtgttttaccgaaagccagatactaaatcaaccaaaaaatgcagggccatagtgactgaccttagtataatcaaggtcattgaagatgaacacagaaagaagaagacagccagaacagagcaaccaagagccaagcctgattcccctgcccccacagtggtccttcggcgaccacccacgcaaaaggtgactggccctgccggttcactgagtgtccaggctcagctggagccatggcaacctttgtcctggccacatgagacaagagttatacttcacggaccacccacgcagggtgaccaagcacacggttccatgctagaccttcttgaaaaggacgaccagcacatggagcagcaggttatggcaaccctactgccaccagaaccacaccagccccggtctgggagaagagccccttgtgtctacaccgctgacctagacatagaaagtgatgagcccgccacgtcagagccggttcttgatcagctactgcccgccccaggacttggacctcttgcaattcaaccattaacgtcccccaccacgtctcaactccgcagttcagcaccgagccacgcacaaactccatggccggttacccacccaagtcagactccaggtggcccaacgacacagtccctggcaccggaaacagaagccccgcgccagtggccaatgccactgcgacctatccctctgcaccccttgcggatgcagccaatatcatttaatcctgcagtgagacccactccccatcagccacctcaggtggagcccactttctatcagtccacttgggtgaaaccccctcaacaataccagcctcagatggggcacattccatatcagccccgaccaacgggtcactctactatgctccggccccagtgggcacccaccaccatgcagccaccaccaagggcgcccactcccatgccgccacctcaggggccacccaccgctatgcagaggcctcagggggcgcccactcccatgccgccacctcaggggacacccaccgccatgcagaggcctcagggtgcgcccactcccatgccgccacctcaggggacacccaccgccatgcagaggcctcagggtgcgcccactcccatgccgccacctcaggggacacccaccgccatacagaggcctcagggtgcgcccactcccatgccgccacctcaggggacacccaccgccatgcagaggcctcagggggcgcccactcccatgccgccacctcaggggacacccaccgccatgcagaggcctcagggggcgcccactcccatgccgccacctcaggggccacccaccgccatgcagaggcctcggggggcgcccactcccatgccgccacctcaggggccacccaccgccatgcagaggcctcagggggcgcccactcccatgccgccacctcaggggccacccaccgccatgcagaggcctcggggggcgcccactcccatgccgccacctcaggggccacccaccgccatgcagaggcctcagggggcgcccactcccatgccgccacctcaggggccacccaccgccatgcagaggcctcggggggcgcccactcccatgccgccacctcaggggccacccaccgccatgcagctgtcaccaagggcacttaccggccagaaggggccagcaaagcacattctgcgccagttgttaacggggggcgtcaagagtgggagaccatcacttaagtttaaggctgcccttgagcgtcaagccgctgcgggcttgcgaccttcaccagggtctggaacgggtgccaagattgtgcaggcacctgttttctatccacccgtcctacagcccatacaagttatgtggcaagtgggttcctcaaaggccgtggccgcctcaacggtgacacaggcacccacggaatataccggggaaaggaggttaggggggcctatgtctcccactgatattccgccgtctaaacgggtgaagaaaaaggcctatccagagcgcaagacgccgcatggggggccctcacactcttccaccgttatgtgggagaatgtcagccagggacaacagcagactctggagtgcggaggaactgataaacaggaaaggaacatgttggggatgggggacattgcagtttcttccccttcctcttctgaaacatcgaatgatgagtgatttcaaccacgtaacaagaactgggatgaaccctcgggcagtatcagactgcggggaggggcagtgataagtcatgacaattttagatgaggtagacattttgcatattttcagacccaccatggaatcatttgaaggagagggggactctatacagtcacctgacaatgcgcggggagatgatgtacagaatactggtgagcatattcaggaccccgggccggggccttcaaccggcggggcttctgagggattggtgcagaacgagccggactcaagagatcaacagtcccgggggcagagaaggggtgatgaaaacagaggctggatgcagcgcatcaggcgaaggcggagaagacgggccgcattgtccggccatcttttagacatggaagacaatgtgccgccgtggtttcctccacacgatatcacaccatatgtcgcaaggaatatcagggacgctgcctgccaggctgtcaaggtgagcatgcctctaactgggttcatgggggccatctaaggcccacgtgtgacccatgtttccattaattttagcactcgcacctgcaagcgctatcaaacctgatactcgatagtggtttagacacacaacacctcttgtgcttcgtgatggcagccaggcagcgtcttcaggacattcgacgtggacccttggttgtagagggaggtgttggttggcgacattggcttctgacatctcccagccgatcctggtccatgggatatcgcacagcaacactacgcacattaactcccgtgcctaacagggttggggctgacagcatcatgttaactgccacgtttggatgccaaaatggggcactagctataaacaccttctccgccaccgtgtggataccaccccctgctggaccaagagagcaagaaagatacgctcgggaagccgaggtgcgcttccttcgtggtaaatggcagaggcggttccgaagaatctttgatttgatagaactgtgtggctctctgcaccacgtctggcaaaacatgctgcagaccgaggagaaccttttagatttcgtgcgtttcatgggtgtcatgtccagctgcaatagttcatctgtgaattactggtttcacaagacaatcggaaactttaagccatattacccgtggaatgcaccacctaatgaaaatccatatcacgcacggagaggcataaaagaacaagtaatccagaaagcatttctaaaggcacaaagacagggtttatcaatgttagcaacgggaggtggacccagaggtgatgctactagtgaaacgagcagcgatgaggataccggtagacagggttcggatgtggagctagagtcatcggacgatgagctgccatatatcgatcccaacatggagccagttcagcagaggcccgtcatgtttgtgagccgtgtgcctgtaaggaaaccgaggacactgccgtggcctacacccaagacgcacccagtgaagcgcacaattgttaagacctcctatagatctgatgaggcagaagaagcacagagcacccctgaaaggccgggcccttccaaacaaccatcagagcccgtggagcccgcccacacaaccccagcggggaggtcaacggtgattctccacgaaccacctcgagagcccgaagctgtttccttcaagcctccgccaccaccttcccggaggagaaggggagcgtgtgttgtatatgacgatgatatcatagaggtgattgatgttgaaaccaccgaagaggagacgacgtcaatgcaaagacagcctccgctcgggcaacaaccgcccccccccgtgatttctaccgggagtgccatgtcttccagtcacacggatccatcagtaacacagccaagtaagccacatcggaaacctcaagacggatttcaacgttcaggccgacgtcaaaaacgagccatgcctcccccagtgagtccttctgacgctgggcctccttccaccaggcctcgtgtcatggcgcctccttccaccgggcctcgtgtcatggcgactccttccaccgggcctcgtgacatggcgcctccttccaccgggcctcgtgacatggcgcctccttccaccgggcctcgtgacatggcgcctccttccaccgggcctcgtgacatggcgcctaccgtcgtacatatgtttacgagggagcgcctgctcacccagtccaccggccctgcacctcggagcttctgggaaatgcgggccggccgtgatgctcccaaaattcaacaagaaccaagttcacaacagcagccagccactcagtctacaccgccttgccaatcatgggtcccatctgtctatgtcctcccggcagtggatgctggtaatgcccagcccctacaaatatcacacttgagctccatgtcgcccacgcagccgatatcgcatgaagaacaaccccggtatgaggatcctgacactcctctggatttgagtttacatccagatactgcaactctgccgcccacccaggatttataccctggacgcgaggatctgcaggccacccaggctccatacccgggatacgaggagccacggcccccccaggctccttttgtaggtgactatggttttgttcaaattccctcggctcaatgggagccacacccctctcagggcacataccagggccacattgatccccagcttccggctgctctagatttagggccagagcagccccggttcccacaagatccatatgtgtattccgggggccaattgtcttcatgtccaggttatgcaggtccctggccctcgaggcctcaacatccaagatataggcacaccttggcattgtggcctcgagaacccaggcatgggcactctcagggcccatggaaaccctggtcagcacatctcccacctcagtgggatggatctgcaggacatggccaggatcaggtctcccagttcccacatctgcattcggagacaggcccaccacgtcttcaactttcatcggtgccacaggtgctgtacccgcagccactggtctcatcctctgcaccatcgtggtcatctccccagccccgagcccccatacgccccattccaacaagattcccccctccccctatgccgttacaagatagcatggccgtggggtgcgactcatcaggtacagcatgcccaagcatgccctttgccagtgattacagtcaaggtgcatttaccccactggacattaatgcccccacgccaaaaagtcctcgagtagaagaaagttctcacggacccgcccggtgttcccaagctacttctgaagcacaggagattcttagtgacaattctgagatctccgtgttcccaaaagatgcaaagcagactgactatgatgcatccactgaaagtgagctagattaaggggatccaaggtgacccctgttagctatttgatctttgactgacacataaacatggtttaaggaatgaacactcatggtgtgagactggaactgtactaaatttgctgacatatgtacaatgagagccaaaaatttgataaaccttaaaagtccccccatctaatgatgtccagttcccttctcccaccctgtacaccccgacccaaagggactcaatggcattcagatttctagttaccacaggtagaatatcgggcgttggcccataaaaataagtgcatggatatagctctgcacaggcttggaaacacccattccaggtgtgcttctttttggtgaaataaaaacagcgttctttatatgaaaatgtgtattctcttgtgttgcagtatgtacagttagctttggtatagtttttgggtacctgaaacgtgtgcagggtgggtgtccaatgtggcagttttatctctttgtccccatactcctgctcggccgtcttgttaaagttaaccggcggtggaggatccaccggccagacctctacatttggtttgggtacccaggtgatggccgctgccgacacccgccctcctcctcttaccctgggtggcaaaaagtatgccaggagtagaacaataacaagtgcgatggcggtaaacaatggcaccctcacctgcttaaacgaaaccatggcaaccacttcaaagagagccaacaggaagatatttattaatattccattagtaaacgaggcgtgaagcaggcgtggtttcaataacgggagttagaaatttaagagatcctcgtgtaaaacatctggtgtccgggggataatggagtcaacatccaggcttgggcacatctgcttcaacaggaggcgcagcctgtcattttcagatgatttggcagaagccacctgcggacaaaaatcaggcgtttagatggggcattttatgtttgggccattagccacctgggcattcgtgttactgtatactgacctcacggtagtgctgcagcagatgcttaaacttggcccggcattttctggaagccacccgattcttgtatcgctttatatctagttcagaatcacattcctccagctgcgagcaagggaatgcgttactacaagtggtgcctagtcagttgaaacaggccccaccgtccgctgccgccctccttgagccccaccatccgctgccaccctctttgagccccaccgtccgctgccaccctctttgagccccttcttaccgattctggctgtagtggtttccttgtacgtcgtgccggggcagccgctggtgcaggctgtggagcaccaatgtctgctagctgttgtccttggttagccccgggacaagcaaacaccactgctgctgctggttgaacagtagaattgtctccaggttgaggtgcttctcccccggcttggttagtctgttgattctgggttatgtctgagactgggaatagctgaggtgctgcataagcttgataagcattctcaggagcaggctgaggggcaggaaaccacgacccagttggagcggctgaaacatgataggcagtgagctggccttgtggcagaggctctggcagcaccggccacagcacacaaggcaaaggagcttgtgatggccctcccaggtcctgatagactctggtagcttggtcaaaagcttgtacaaaaggcacctggtatgggtcaggtgtaaattttacatcttcagaagtcgagtttgggtccatcatcttcagcaaagatagcaaaggtggccggcaaggtgcaatgtttagtgagttacctgtctaacatctcccctttaaagccaaggcaccagcctcctctgtgatgtcatggtttgggacgtgctaaatttaggtgtgtctctgaggcacattagcaatgcctgtggctcatgcatagtttccaaaagaggaggaggcagttttcagaagtgtctaaaataagctggtgtcaaaaatagacagcccagttgaaatatgcatggcatgcagcagacattcatcatttagaaatgtatccaagatttcattaagttcgggggtcaggggggagtccagattcaaatcctctgtcatggactctagtgttgtggtcagttcgtccaaatggccacgagggggcgggtggttcaggtccatctgtccacatatggctgcttcctccttctggggaataacagtgtcagccatctcccttagggccttcacggcctgactggtttcctcatcagggtcctccaacagatgacttgcctcgggggttactgcgggggccgggtcaagtggccggggcactggggctggcgttagggatccgaccggttcatggacaggtcctgtgggggtgggagccaaagaggcaggcaggggccggttggcccacggggatccgggtggatggaagggcctgatcctctttggctgacacacctctcgcccctcgaacacgtcagatatggcactgcccgcttccggctttggcaggaacataccttcccggctatccctgaggcccttcttccttttaacgggaggaagaaaggtgggctttgaggggtgggggaatatgggtctctcatcgctctcttggtggaccgctgctatccaaggctgttcaggttcctccgcgttggaaggacatggagtttgaccacggttgggcctggatgtccggcgcgactttggggcccgcaggcgcggggcctcggccctggcctcttcccgctcgctctgctcggtgtcactgttgcccgagtcactgctgctggaactgctgtcaccgcagtcggcgctttgggcaccgggcttcaggggcatggtcgggctcgggagactttcgagttcatctgtaaaagcatgaaactgtccggactccgagtagcgggcctcggtgtgagaggcacccccatcattccccatgagctcctcgtccatcctgtcggctccggacacgaggataggagtttccactgccttggacttggttgacagcaggcacgcgggaagcacgccgctcacgtagctcctctgtccggcgtggctggagtaggaggcccggggcagtgtcttaatcagagccctgacatccttaacatcgtccgtcagatggcctgtcttggacgagaccatagtctggaacatctcctcgaggacgggataggtgaacacccacttgcaaaaggccttgaacttggagcttaggaggccttccttctccatcctgttcaggtgttccactacctgcttgccggaggccatgatggccgcgcggtccacgcccagcaccttgctgtaggtgtaggcccgcacccgactgtgttttaggagcttgtacatagcggtgcctatggtggcaggaatcatcacccggttgctgggggcctggatgaagaatctgtcagtgaccactatcaggtggtctaacacgtagcgcatcactatagggcacgcgatggaacatgcgtcgttgccggcattctcagcccgtcttcttaccctgttgtttcggagaatggcccaaaaattgcagatgttgagcgtggccattagcccgccccattctcgcccgtgggccttggcctcatttataaatgccttgcatattttgtaggatctcagagtaatctccacactcccggctgtaaattccttgttgaggacgttgcagtagtcagagaccagagagcccagctgctttttgatttcaggagttagcctcagaaagtcttccaagccatcctttttaggcctcatggctagtagtaacagaggaaatgcccgaccattaaaatctttcctccatgagctttacctgaaacactatcccgaagtgggggatgtggtgcatctactgaacaccatcggggtcgactgcgacctcccacctagccacccactcctgacagcccagagggggctgttcctggcaagagtcttgcaggctgtacagcagcacaagctgctggaagacaccatcgtccccaagatcttaaagaagctggcttatttcttagagctgctaagctactactcccccaaggatgaacagcgtgacatcgccgaggttcttgaccacctcaagacgaatcgggacctggggctggacgacagactctgggccctgattaggaaactgcgccaagacagacaccatgcctctgtaaatgtcctcatgccaggaagcgactacacagccgtgtcgctgcagtactacgacggcatctccataggtatgaggaaggtaatcgcggatgtctgccgcagtggctatgcctccatgccctccatgacggccacgcacaacctctcccaccagctcttgatggcgtccgggcccagtgaggaaccgtgcgcctggcgcgggttctttaaccaggtcctcctctggactgtggccctctgcaagtttcgcagatgcatttactataactacattcagggatctatagccaccatctcccagcttctgcacctcgagatcaaggccctctgcagctggataatatcccaggatggcatgcgcctctttcaacacagcaggcctctcctcaccctctgggagagcgtggccgcaaatcaggaggtcacggatgccattaccctgcctgactgcgctgaatacatagacctactaaagcacacaaaacatgtcttagaaaactgttctgccatgcaatacaaataaatttctcttacctgcgtctgtttgtgtagtgaggtgttgtgtcctgtatggtattctactttaaaaatgccggctgacatggattactggtcttttatgagccattggcatgggcgggacaatcgcaatataaaaccctgaccatcacatggggcattaggcgactctgcatcagcatcgcttaagtatgagtgggcagcagagaggctcggttattttggttcctgaacatctggctggggcattaactaagcttatgagcgattttatcacaggacaagatgtcactctttctggaggaaatattgcagtcaaaattcgcgatgctataaaccagacccccgggggtggtgatgtagctatactttcttccctgtttgctttatggaatgccctcccaacatctggtagacaatcctccagggacgatttaatcccagccgccgtgcaggccttaaccacggcccacaacttatgtctgggtgttattccaggtgagacctcacacaaggacacacccgagtcattgctccgggctatcgtgacgggtctccaaaaattgtgggtggattcgtgcggatgtccagagtgcctacaatgtcttaagggattgaaggcaattaagcccggcctttatgaaatccctaggataataccacacactaagcagtgtagtcctgtcaatctcctgaacatgttggtccacaagcttgtggctttacgtggtcatgtgcagcttgcatacgacgcccgtgtcctgacgcctgactttcacgaaatccctgacctcgatgactccgatgctgttttcgcacgcaccttattggcagccttatttcacctcaatatgttctttattctcaaagattacataacacaagactccatgagcttgaagcaggccctcagtggtcattggatgtctgccacgggcaaccccctgcctgcagcaccggaaaccctgcgagactacttggaagctttccgaaattcggataatcacttttatctcccgacgacagggcctttaaacaccttcaaatttcccgaagagcttctggggcgcgttgttgtgattgattcctctttgtgtgccgccagtcacgttcaggacgttatcacccgtggtgttggggcgggtgttcctcgtcctcagtttttggccctgcctccggccccatcccgtaagccccagcagacatgctctcagttaacgagcagaggaaatgaaagctcacggcgaaacttgggccagcccggggggacctcccctgctgttcccccagtttgccccatcgtttccctgacggcctcaggggccaagcaaaaccgcgggggcatggggtccttgcacttagccaagcctgaggaaacctcccccgccgtctccccagtatgccccatcgcttccccagcggcctccaggtccaagcagcactgcggggtcactggatcctcacaggccgcacccagctcttcttccgttgccccagtagcatctctgtctggtgaccttgaagaggaagaggaggggtcccgagaatccccatccctaccgtccagcaaaaagggggccgatgaatttgaggcctggcttgaggctcaggatgcaaattttgaggatgttcagcgagagttttccgggctgcgagtaattggtgatgaggacgaggatggttcggaggatggggaattttcagacctggatctgtctgacagcgaccatgaaggggatgagggtgggggggctgttggagggggcaggagtctgcactccctgtattcactgagcgtcatctaataaagatgtctattgatctcttttagtgtgaatcatgtctgacgagggaccaggtacaggacctggaaatggcctaggacagaaggaagacacatctggaccagacggctccagcggcagtggacctcaaagaagagggggggataaccatggacgaggacggggaagaggacgaggacgaggaggcggaagaccaggagctccgggcggctcaggatcagggccaagacatagagatggtgtccggagaccccaaaaacgtccaagttgcattggctgcaaaggggcccacggtggaacaggagcaggaggaggggcaggagcaggaggggcaggagcaggaggggcaggagcaggaggggcaggagcaggaggggcaggagcaggaggggcaggagcaggaggggcaggagcaggaggggcaggagcaggaggggcaggagcaggaggggcaggagcaggaggaggggcaggagcaggaggggcaggagcaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggcggggcaggagcaggcggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggtggaggccggggtcgaggaggcagtggaggccggggtcgaggaggtagtggaggccggggtcgaggaggtagtggaggccgccggggtagaggacgtgaaagagccagggggggaagtcgtgaaagagccagggggagaggtcgtggacgtggtgaaaagaggcccaggagtcccagtagtcagtcatcatcatccgggtctccaccgcgcaggccccctccaggtagaaggccatttttccaccctgtagcggaagccgattattttgaataccaccaagaaggtggcccagatggtgagcctgacatgcccccgggagcgatagagcagggccccgcagatgacccaggagaaggcccaagcactggaccccggggtcagggtgatggaggcaggcgcaaaaaaggagggtggtatggaaagcatcgtggtgaaggaggttccagccagaaatttgagaacattgcagaaggtttaagacttctcctggctaggtgtcacgtagaaaggactaccgaggatggaaattgggtcgccggtgtgttcgtatatggaggtagtaagacctccctttacaacctcaggcgaggaattggccttgctattccacaatgtcgtcttacaccattgagtcgtctcccctttggaatggcccctggacccggcccacaacctggcccactaagggagtccattgtctgttatttcattgtctttttacaaactcatatatttgctgagggtttgaaggatgcgattaaggaccttgttttgccaaagcccgctcctacctgcaatatcaaggtgactgtgtgcagctttgacgatggagtagatttgcctccctggtttccacctatggtggaaggggctgccgcggagggtgatgacggagatgacggagatgaaggaggtgatggagatgagggtgaggaagggcaggagtgatgtaacttgttaggagacgccctcaatcgtattaaaagccgtgtattcccccgcactaaagaataaatccccagtagacatcatgcgtactgttggtgtatttctggccacctgtcttgtcaccattttcgtcctcccaacatggggcaattgggcatacccatgttgtcacgtcactcagctccgcgctcaacaccttctcgcgttggaaaacattagcgacatttacctggtgagcaatcagacatgcgacggctttagcctggcctccttaaattcacctaagaatgggagcaaccagctggtcatcagccgctgcgcaaacggactcaacgtggtctccttctttatctccatcctgaagcgaagcagctccgccctcacgggccatctccgtgagttgttaaccaccctggagactctttacggttcattctcagtggaagacctgtttggtgccaacttaaacagatacgcatggcatcgcgggggctagacctctggctggatgagcacgtgtggaagaggaaacaggagattggtgtgaaaggagaaaatctccttctccccgacttatggctagatttcctacaactcagccccatcttccagcgcaagcttgctgccgttattgcctgtgtccgacgactgcggacacaggccaccgtctacccggaggaggacatgtgcatggcctgggcccgcttttgcgacccctctgatattaaggtggttattttgggccaggacccctatcacgggggtcaagcaaacggcctggcattcagcatcgcatacggctttccagtcccccccagcctgaggaacatctacgcggagctgcaccggagtctgccggagttttctcccccagatcacggctgtctagacgcgtgggcctcccagggggtgttgctactcaacaccatcctgaccgtgcaaaagggcaagcccggctcgcacgcagacattggctgggcgtggtttactgaccacgtaatttcattgctctctgagcggttaaaagcgtgcgtgtttatgctgtggggtgcgaaggcgggagacaaagcttcactaatcaactccaagaagcatctggttctgacctctcagcatccctctcccctggcccagaacagcacccgaaagagtgcccagcagaagttcctgggcaacaaccactttgtcctcgctaacaactttttgcgtgagaaggggctcggtgagatagattggaggctgtagaggggtcatcactatggccatgtttctgaagtcgcgtggggtccggtcttgcagggaccggcgcctcttgtcggacgaggaggaagagacttcacagagcagcagctacactctggggtctcaggcctcccagtctatccaggaggaggacgtgagtgacactgatgagtctgactactcagatgaagacgaggagattgatttggaggaagagtaccccagtgacgaagacccatctgagggcagtgatagcgacccctcgtggcatccttcagattcagacgagtctgactacagcgagagcgacgaggatgaagcaacccccggctctcaggcctcacgatcttcaagagtctcgccatctacccaacagtcttcaggtctgacacccacgccttcgttctcccgaccacgcacccgggcacctccgaggccgccggctcccgcgccggtcaggggacgggcctcagcacctcccaggccaccagccccagttcagcaatccaccaaagacaagggtccccatagacctacgcgacctgtacttagaggcccagctccacgccgcccccctccaccttcaagtcccaatacatacaataaacacatgatggaaaccaccccccccattaagggcaataacaactacaattggccatggctgtaaataaaatgtcataacctggagtctgcatgtctgttgttttattcagtaaaccagtagtgcgcgtgagttctttagggcatccacgatgtagccgctcgcggggttcccctccccagtgatcatctcggataggggattcctgtccatgaccacgcaattagagtgccgggcccgggacagcgccacatacacatggccgggtttgatgtttctgtggctgccgaagcagatggcgactttgtttagggacagaccctgggccttggctatggtcatggccagctttgagctaatgccatagtcacggatgctgcagaggttcagggacttgtcctctatcgtctcatacagcttgttagtattgtgttccaggcagcacacgaagcctgcctcatccttgaccattagcctgggcatgcgtgaactgccagcgtcctgaggctgctgctttcctcggatgccaaagaagacgttgagatgcgtgtagcccagaagcgtgtagttctcggtggtggaggcgtagtccaggaggccgtgaaggagaggctcgtctgaggtgaactctatgttgtcgcgaatcagcatgttgttggtaaatgtgcagaaggggaggtccctgaactcccttctgccatagcggacggccacatccaggcattgcctgaaataggccctgaggtcattatatatgtttaacagggagcagaggggggcagaatttgcggccgggggagccagtactcgggcatagaagacagcggcggggctccgctccccatcccaggcaacctccagcggcagttcacccagctccatcccagcagtcacctccggatcccacgtacgcccgggcaggggcacagcaccaagctccgccacgtattccccgttttcacagagagaatgtcctccgtggctaaaagcgtagatgccgccgtagatgagtcgggccaggaagctgtagacatactcgggctgctcatgcccgtgggcctccacgaagctgtccgcctcgagcgtgtccataaagtccccgaaggtgccggtatagccacagatggactttttggtcttgcagttgaccgacactgagctgtgcttcacgtaggtgacattgtaggtgaccttgacccgttcttcatcctgctcggttcccaccgggaccatgtcttggtcggcgaactgcgagtagttaccgaggcgtgcataattcttttggagccaggtgtgggccgtgaggcccggaagaccgaccagggtcttgtactgggccaggggctcgaggaagacctcgcactccaccgggcaggtaaacatggtcaccccgcccccatctcccccagttccccgcgcggcgcgcccctgcccggcagtcttgagcgtggcgtggagggtggtgaggaaggtcttgacctcggcgtgggagaggaagagccgggtccagcccacgtactgcgtggggtccattatggccgccctggggacgacgaagcggtcgacgtaggccaggatgtccggcgagagctcgaggccgtactcgagggtcttcatgaggtgtccaaactggacgtcggtgcagcgcttgttgttgatgaagagggcccagttgcgggccacgtccacgtaggtcgcggccctggggttgcccaccaggaaggtgaggatgttgtcgcactcgcgaatcttgtttacctgggtctcgtggctaaaggaggactgaaaggcgtctgtctgggtgggagagcccacgcagacgatgcagggaatgcggccccggcggtagagtggggtgcgcagccaggcgttgaagaaccagtagcaaaagaccacggctgttagaatgtgcacggaaagcgttccagcttcgtccaccacgatcacattggtggtccatagctgcccctggtgcatgtctctcaggacctcaaaggcggggccagagactcccgagtatagccccctgggcttggttcgcctgaactcggcggcaatgtcggagagtaccggccagtatttggccatgtcccgccgctggagttcctctagggcggcgtccgtagagcgaccatgactgctgacccgctgcgtcatatttatgtggcggctcttgaacccaaaggcgctatagacggttgggcagtaggctcggagtgtctgggagaggttctgtgcggccacggttgtggctcccgtgaccaggcagtccatcgtgtggtggaggcagctaacgctggtgctcttgccagcccccgccgttcccgtaattacataggctgaaaagggcaggaaggggggctccgagatctccgggtcaaactcgggggagaacgtctccatatccgggagttgttggacgcggcgcttagccagggtccctatcctcctgactatacgcctcacggaggcgtctgaggtcatgttcaacatgaacgtggacgagagcgcctctggcgctctcggctcctcggccattcctgtgcaccccacgccggcctcggtccgactttttgagatcctgcagggaaagtacgcctacgtccagggacagaccatctacgccaacctccgtaaccccggagtcttctcgaggcaggtgtttacccatttgtttaaacgagccatctctcattgcacgtacgatgacgtgctacatgactggaacaagttcgaggcctgcatccagaagcgatggccgagcgatgactcgtgtgcgagccggtttcgtgagtccaccttcgagtcgtggtccacgaccatgaagctgaccgtgcgtgacctgctgaccaccaacatctaccgagtgctacacagccgctccgtgctctcctatgagcgttatgtggactggatctgcgccaccggcatggtgcccgccgttaagaagcccataacccaagagctccactccaagataaagagcctgagggacaggtgcgtctgtcgggaattggggcatgagaggaccatcaggagtatcgggacggaattatatgaggcaacgagggaaataatagagtcgctcaactccacgttcatcccccagtttacggaggtgaccatcgagtaccttccggggagcgacgagtatgtggcctactactgtggccgccgcatcaggctgcatgtgctcttccccccggccatctttgccggaacggtgaccttcgacagcccggtgcagcgcctataccagaacattttcatgtgctaccgcacgctggagcatgccaagatctgccagctcctgaacacggcccctctcaaggccatcgtgggccacggggggcgagacatgtacaaggacatcctggcccatctggagcagaactcacagcgcaaggaccccaagaaggagctgctgaacctgctggtcaagctctcggagaacaagaccatcagcggggtcacggacgtggtggaggagttcataacggatgcctccaacaacctggtggaccgcaaccgtctatttggccagcccggggagacggctgcgcagggcctaaagaaaaaggtctccaacacggtggtcaagtgtctgactgatcagataaacgagcaatttgaccagattaatggcctagagaaggagagggagctctatctaaagaagatccgctccatggagtctcagctgcaggcctccctgggtcccggcggcaacaacccagcggcgtcagcccccgccgcagttgcggcagaagccgcgtctgtagatatactgacgggcagcaccgcctccgcaatcgaaaagctgttcaactccccgtccgccagcctgggtgccagggtgtctggtcacaatgaaagcatcctaaacagtttcgtttctcaatacatccccccttcgcgggaaatgactaaggatctgactgaactttgggaaagcgagctgtttaacaccttcaagttaacacccgtggttgataatcaggggcagcgtctctacgtcagatactcgtcagacacgatctctatattattgggccccttcacctatctggtggcagagctttcaccggtggaactcgtgacagatgtctacgccaccctaggcatcgtggagatcatcgacgagctctaccggagcagtcgcctggccatctacatcgaggacctcggtcgaaaatactgccccgcgagcgcgaccgggggagatcatggcatccggcaagcaccatcagcccggggggacgcggagcctgaccatgcaaaaagtaagcctgcgcgtgaccccccgcctggtgctggaagttaaccgccataacgccatctgcgtggccaccaacgtccctgagttctacaatgccaggggggaccttaacatccgagacctccgggcccacgtcaaggcccggatgatctcgtcccagttttgcggctacgtcctcgtgagtctgctggactccgaggaccaggtcgaccacctcaacatattcccccacgtgttctccgagaggatgatcctgtacaaacccaacaatgtgaaccttatggagatgtgcgccctgctctcgatgattgagaatgccaagagcccctccataggcctctgccgggaggtgctgggtcgcctgaccctcttgcactccaagtgcaacaatctggactctctgtttctgtacaatggggccaggacgctgctgtccaccctggtcaagtaccacgacctggaggagggggctgccacccccgggccgtggaatgagggcctgagtctctttaagctgcacaaggagctgaagcgcgccccatccgaagcccgggacctcatgcagagcctctttctgacctcggggaagatggggtgcctggccaggtcacccaaggattactgcgcggatctaaacaaggaggaagatgccaactcgggcttcacatttaacctgttttatcaagattctttattgaccaagcatttccagtgccagaccgtcctccagaccttgagacgcaagtgcctcgggagtgacacggtctcaaaaataattccctagaataaactgagaacagtcatcagtaaatctgtctctcgcgtgatttccataggaatggtgtagccggggtggagggccgatatcacatcaagcagaaaggccataatctctcgaaagtaggcggtggggctgagaccatgctcagtggccgtctggcagggggccgggcgcgctccgtccttgtccaggagacacacgtggcttccagagaggcgcagcccagccctccgcagccgctgaagccaggctcgcggaagagcccaaaacctgtttcggcgccgcccgggggccagtctccgggtcaggtcgcggaccagggtcaacaggtggtcgtgggatggcggggccttgtctgcctcgggtctcgccgctagttggtccagggtccaggagaaggcttcgtgccaaaccaaaaagggccccgagtgctccctacatccacccacgtaaagatccccctgaaagatggccatcagtaggcacccgggcccgcgtcgagccttcacccgaatgtgtctgcgggccacggtggcctctccacccatcacatcccggtcgagccggctggcatcctccgagtctttcacgccttgcaggaaagcctaggagatacagcaacagaaagctattagccggtggttcccccaccatcattcttcctgttaacgggaagaataagagttgggcaaaccccgggggccgcgctctcccacccagccccgcttctcacctgtgctagtggctcctctgaaggatgggcggaggttggtgccacaaagcccaggatgaactcgtctgcataagcccaggtcagtcctaggtcagcggccgcgtgtaggagaacccgggtgacggcggtgtagaggcccccgagtgcccgtcgcgtgtctgaggtgccatagcggtgaagggcccgcagccaggtttgcgcgtcccgcgcctgccctccgccatcaggcgttcccacgggggcgcccctggcagagaggtggcagcgggccaattcgtagagccaccaagtggcatcagcctcaaggatggctgtggcctccgcgcgcccgaccaccgtcgtctcgtcctccccccctccctcgccgccttcccgcgtgcaaacgtggcgagggttaatctcctttcgggtcgggggccagatttgttgtaggagcagcgagccgcgtcgttgccctgaccgcgcgtcgaggcccaggagggcgtctgccaggggcgtcccagagactcccaggttcaggtccagtagcaggagaccctcgctgtgtggcgcccggtgccagaaggccggcctcgcccgtcccacataatggatgggcaggaagggaaagcccgggacatagggctggaaatctgagccccctgggcagagttcggggtccaggaggtagaagatgggcttggtgcctctgtggttggcgtagcaggaggcatagatactgcggaggaaggcgtagagcccgcccccggccatactccaagagttgacaagccaggactcgaatcccccagccggctcaagaattttcaggctgacgcggtgccgtcgggcgtccccaccacggccggtggccccgtcggacgacaccagatctacttcataagtgaccggtcgcaggatgtccctaaaggggacgggagaggggtcgtcgggagtctcggtggaataggtgaaaacatccccacgcggtgtcctgatgtatacgtccaactgtccgggagactcagagtgcctctgagcatgggggcatgtctgttccccctccatctcggacccgaagccatcaacaggtgggggttgttggtcccgcccatcatcccccgagcagctttggcagaccacctgtgctggaaagagaggctggaagatgaggccctgctcatcctccaccctggcggcggacaagagtctgcggtctcgggttctaaatgaaaggtcaaataggtccttctcggcggcatcggcgagcatagcaatgagccccccgctgcgcctgagctcccgctcccatcgcaaaaagttgagttcggtagtcgagggcgcgttgaccacggggggctccagggagcctccaagcggcggctggcaggcctgcaccacgatcagagtctcaacgtcctcccttttgatgggcacgatgcccacgacccaaatcgcccaccaccgccctgcggtctgggtgacattataaaaggtaaccgagctgacgcgggccctgacgctctccgcgggtgtttccatcattgtttgagatctgaggaggactggaccctttaaaacatccggtcacgccctttgcaaattatttaaaaggtgaatgctcaactgagaccatcgcaatcatgaagtcctccaagaatgacacgttcgtctatagaacgtggttcaaaacgcttgttgtgtactttgtgatgtttgtcatgtcggcggtggtccccatcaccgccatgttccccaacctggggtacccctgctactttaacgcactggttgattacggggcacttaacctgaccaattacaacctggcccaccacctgacccccacgctctatctggagccgccggagatgtttgtctacatcacactggtctttatcgcggactgcgtggctttcatctactacgcctgcggcgaggtggcgctaatcaaggcccgaaaaaaggtctcgggtcttacagacctctcggcctgggtctcggcagtgggctccccgaccgtgctgtttttggccatcctcaagctctggtccatacaggtcttcatccaggtcctttcctacaagcacgtctttctctcggcctttgtgtactttttgcactttctggcctcagttctacacgcctgcgcatgtgtgactcgcttctccccggtctgggtggtcaaggcccaggacaactctattccccaggacaccttcttgtggtgggtggtcttctacctgaagcccatagttacaaacctgtacctggggtgccttgccctggagacgctggtcttctcgctcagcgtgttcctggccctgggcaacagcttttactttatggtgggggacatggtgctgggagccgtgaacctcttcctcgtcctgcccatattctggtacattctgacggaggtgtggctggcctccttcctgcggcacaactttggcttctactgcggcatgttcatcgcctccatcatcctgatcctgcccttggtcaggtacgaggccgtctttgtctccgccaagctgcacaccactgtggccatcaatgtggccatcatacctatcctgtgctcagtggccatgctcatcaggatatgccggattttcaaaagcatgcgccagggcactgactatgtccctgtctcggagacggtggaactggagctagagtcagagccgaggcctaggccctcgcgcacgccatcacccgggcgcaaccgccgccgctcttctacgtcctcatcttcctccaggtcaaccaggagacagaggcccgtctctacccaagccctcatctcctccgttttaccgatgacgacggacagcgaggaggagatcttcccctaatgcaataaaaacttaaaacactgaggttactttcccgtcattctttcgggggaacgaggggaggcgggaattgggttaagataggggcgaagggtgggggtgggtgcaagaattggggctgggaatggagaggggagtgggctaggtgccgacaccggggtgccaagataatggattgagtaagcatggggctctgatcgggtccgccgggttctcaggggtgtagtgggtgggcattgcatatttttgccgcggtgctgttgggccttggactcggggtgatcatccgtaccatcacccgcacccgcaccccagtccacagccaccggccaaggtcctgggcctcccaccaccgttatgcctccccctttacccattaattacaagagatgttagtttggttttttatttggcaaaaacagcaattcatcattttcagagtcctcatcatattcgagcccctcgttggtttccccgcaggccctcccttcttcggccgctattagcttagtagtctccaggttaaactcctcatagtcattatacaggttgattattcccccgtccacgtcgcctatggagttgactcgtcgtcggcaaagagaccagagggcacccatggcgcggtgtcaaaagtattgtctgcgtacgctttccaggagccagccgcggtgctcaaggtcttacggatgacagagtccggcaggaccacgggtgtcaccagcaccgccacgggaatctccaccgaggcgtccagaagcaggtctgagccgagcgtgcaggtcgccgggtctagaggcgaccgttttcgaaagaaggccgtcacaatgttcacccggggtgagcagtctctcccgggcttgccacccccactgtggcggacgtagtctccaacaattttgtattggaggagcacctggtagaagtagttgtgccgtggattgatgaagatgttgactgggacccggtctttaataccaatgcgccccgcattttcgcttgggtccgtcattacgtagagcatagactccacccccctgttggcagctaggctgtctgccaccaggtcatgaccggggcccagtttgcgcttacggacatctttaagattccaggcctcatcctgcgtcaacagatagtcaccctccgagggcaaccgcccatccgggacgtactccacggtaggacgagctatagaattgataaatctgataaatgacctcttgcatggcctcttgtaaagcgcagtgtaggatgggtagatggggtcaaattctgacttggaaaagaggtacttgaagcggcacttaatctcataaatgcagctccggtcggtgaacagtataaagtctccctgtgactccacattgacgcaaagatccagagacaccccaaaaatgccatccgtgggactaatcataaagccaaattgacggttggcggatgcgtccccgcagatgagcttacagacaatgtccttgaccgtgtcctcacaccgcaggccaaaggccacaggtcccccaaagtagtgatttgtggagatgggagctggctcaaacaccttggtgggtccattcttaatggtggagagcagcttggaagaggaaattatgccatttcgcaatatgtcccacatcaggttctcagactgccccctggtcatggactccacgtacgagcagagaacagtcctctgctcgtcggtggcctcctgtagcccccagtaaatggatttcagggagggaccgtcctggctgtcattctcttggactaacgaggagacaaagtcacagaagccagtttcaccagagaactcttgtatttgttcacagaggcaatagagatagacatagcgcatggccggcatctgaggtggacggtcaaggttacggacaaaggcctcagtctccggactgcggaggaagcgggcaaacgtgtaggaggtcatctcctccatgggatcctcgagctcatccacgtcggccatctggaccaaagaagtcgtctgccaagagttcagctaccagacctggaagatgagggtgctcaaaccgtgggcgacagttgaagaagtagctctccttgaacctctttttaaggctccggcaccactgcaagaattgactcatatgctccgccgtgacatccacgcacggactctcgccacacgaggtcaggcccatgtctaagttcaggttccacatctgcgacagcacctccaacagcaccacctttggggctgcaaattgcaaaaagtagagcgggtcggatcggtcaaatcccatgtcagggttggggtaggggattttgtgggtggagtcagcgaggtgcatgataccatagagcagcgagtagccgagcgactgcagatccaggcgaagggccgtctgcgcccccacggggccacacgccgaggggtcagggatgtgcccagcccccctcaagatgtagcacttgctcaaaaggcagaggggcttataggtgtccttggctatagaaaatggttccctctggcaatagaggcgatagagctgccggcccttagaagactttagccgcacatccagcatcttgttgcggtcgtggagggaagcagtcccataatcagtcaggaccagcctacccatgccccacatggtgtctgtgaaatccaccaggatgttgctggggctaatgtccgaatggaagaggccgcagtgccgattcagaaagtaaacggcatctttgaggccctgaaagccccgcaccaggggctcaatactaccatcatgccagtggccataatcctggagactgcatctgaactggggcataaacagggcgtggcaggacgtgcaggccgacaggtagtccaccagggccttgtcctgcccatcctcggccgtggccttcccaatctgaatcatgtcacacaccatgagctcgtgatacagctccgtcacagagtcatagagtttgaccgtggcattatctgcatgtgcatacacggccccgtagctcccccgccccagcagatactcgcaggtaatggggaggtgatcacagcgcgtcatgttctccggcagctttacatagagggtctccgtcatgtcatcaatgttggtcaccttcaggtgtttgtgctgaaaggtgaagtaatcaatgacagtcaccttccccaaaaaggcctgggtctctcgagggggttctggggagacactcaactcgccactgctggaggagttcgtcgggctcaactccgcagccatattcacatccatgttcctcaaatggctcgagggcctgtcgcagctcgtctctggcctcaagctcctgctcacggagctcctccacccgctctagctgcttgtagttgatttttggaaattgagtcttggtcgcggtgaccaccctctgataggtagaaattagctgtttggactcaaacgtctcccttgcgcggcgcagggactctaaggcaccccgagcagatgtaaactgtgtttcaaacagagcgtggtccctcccaaatctgtcacgtgcgctcacagccgctctcttttctaccgaggctcttagttgctgggccaccagatctcgcttagaactactcatcttcataagtcaccatgtccgcaactatggagcccagatcatacgtggggtagagtacggtagttccagtggaggcttcccggtaatttcccacagcgtccaccatatatctttctgcctctcccgttagaattaggcaaggatcatacgtgtccaccggccttttatactgagcgtttaggttttgtttatgtagcaagcacaaaaggcacacacgagtgatgcaaaagggttcctgaggcagcaggcagagctgttttgccattttattcaggcggctaacgtcaaagggaggagctatatcctcacccttccagtcacgcacgtccaagtacagggcatacacacacctggtgaggtgtgccaggaatgcctctatgttggcacatggtgtataaaccgcagtgggtagcagaatagggcccctcttgccccgtgctgcagcgtaaacacagtgacgctcttcgcagtgggacctggggccgtagaagagggcccacatccaagggagtgggtcttcaggcaccagggaggtccaggtatgggagtgggccaatatttgcaaggcctgacctataacctcatctttgttccaggccagcgcaattcgcataaggtccccatcaaacacctcaaaacacagacccatgcccatttcaggctgagagggctccatccggctcgaccacccttgtccaccaaactgccattcttctggtaaacggggattgaggggcaagagctccaaagccaggctcgagaagtcatagtcatcctcggccacacggccggagctccgggcctcgtgccagggcctgttgtcctgggggaggatattggacacgagcaggaagctcttgagtggcgtctccaccagcttaaattgctcgggcgtgtcctggcaggcctccagtgccagttccagacactgcccatacctgcgggcgagcatcgggtcatcgggcatatcggccttgaccgcgttgaacatgctgtatgcctcgcagcgcggccgtctgaccgagaacctaagaaacgccctgcagcaggatagcaccacgcaaggctgcctgggtgccgagaccccgagtattatgtacacgggggccaagtcagacaggtgggctcaccctctggtgggcacaattcacgccagtaatttatattgcccaatgcttcgagcatactgccgccactatggccccaggcccgtgtttgtagcttctgatgaatcattacccatgttcggtgcgagccccgcccttcacaccccagtccaggtccagatgtgcctactaccagagctacgcgacacgttacagcgcctgctgcccccacccaatcttgaagactccgaggccttgacggaattcaagaccagcgtgtcctctgcccgtgccatccttgaggaccccaactttttggagatgagagagtttgtcaccagcctggccagcttcctgagtggtcagtacaagcacaagcccgcccgcctagaagcattccagaaacaagtagtgttacattctttttattttctgatctcaatcaaatctttagagattacagacaccatgtttgacatctttcaaagtgctttcgggttggaagaaatgacgctggagaagctgcacatttttaagcaaaaagccagcgtgtttcttatccccaggcgccacggcaagacctggatagtcgtggccatcatcagcctcatcctctcgaatctctccaacgtgcaaataggctacgtggctcaccagaaacatgtcgcgtccgccgttttcactgaaattattgacaccttgaccaagagcttcgactccaagcgtgtagaggtcaacaaggagaccagcaccatcacgtttaggcacagtgggaaaatctccagcaccgtaatgtgtgccacctgcttcaataagaatgtaagacctgacgtttcagtacttggcaattgtagagcatagcccggctgtaaaggtcagaaaatcgcagcagggtccaaggttgtgctgtacatgggacctctttcccattagcaagaaccccctgcaggacgcgtgacatgtccgggtgcattttgggtgggttaaatctcagtcccaccacaaagggggcatcctccggtttgaacatcagacccaacaaagcccgatgcccagttatgggtacgtagtcgttgttcagggccgtgcatggtagcagacaaggacaggtgccagatgtgcctgggctatcgtcctccgtccagccacgcaggatgttcacgtgggccccggcaccatagcatgtcacacattccccgttatcacatctggttagcaggttgataaaatgggtcagtgatggaaaggttggcatattggggcagcacatcagcatgtccatgttaacgaaaaacatgtacagggccccttctgcataccaggcaccaccccgtcccagtgggatgatctccgagggtgtgatatcttgcagttcttctactgttttaacggcggttgaggtggtaaagacgtgggccgtggtcagatctgtgcaggtgactacagggtttcccctaatctccacaggcaccgcctcacccacggcatctgagaataccccaaagtacatgagagtcaggctgtgtggcccctggactgccttagtgaagagaacctcgggcctggccacggtggctagggttccattgatgtagacggtcacataggtgggcttcttcttgggcttcagcacaatgagggtaacattcatgtaggttttaggaggtccggctatctgaggcacgtacacagctgacacggcggttgtggccgtatagactttcatctggggcgtagaggcatcgctcagcacccagaggcactccttgttgaggaacttgcgaagctgttcccggctactgttcgcggcggatgccatgacgtgccagaatatatcccctctcctcgggggtgagtgccaattggcctttaataacaaagcccccaggcagcaccaaaaatgcctgcccgtccgatgtggtggccaggtggacgcagtgcccgtcagttccaagggctactagctgggaagcagccccaaccagcccaccggggggcctggagtcgatcaccttaccccaggccgaggccccttcctcatacagcgggtggctatctatccataggcaggcatccggcgtctttggtgcattggagatagctttcacccaacaactttcccaactaacccgtgtctggacagtgaagaacgcttccctgatcaggtctgaatttttatagatacgggagtaggaggtgggaataacaactgggatttcttgttgtgctgtccaggcctgcatggccagtttttccctgaagctagcagaaattctgagggccactgaaatgaggaagcgaaactccctctctggagctcccaaaattgaaacctcagcaagatctgttgctggggaggcatgggtgacagctgtcatcctgtgcagtctgccctgggcactcagctctggatatgtgacaacatagagagcgtgggggctaaaaatatgagcaattcccctgaccagggccctggactcacgaatggcccgacgggtcttagagaaagaaacaggcaccctcgagagtgcccccgacccgacccccacagtgccgccagtccctgctcggcctccgccgccttccccaccggcgctgccccggatgttgctggggttctcgagggctgggtggtgcttggacacagaggtctcagcagccgccttggtctcggccccggccctaagtctgagccccaggcaaagggccggactcccagcgtggcccaacctctgctcccctctattctcctcttgcgttatctccaatagaatttgcttgaggtcatacgttttagggtgctcgacctgggccgcggccatcggcatatgctctatacccgcccctccggggggcccaggatctataggtatgggctgcatagccgcagcagactcctggaccccagaggcctctctgatcagatgcccgtcggtcagagcccttttggccccctcaaagagagacaggtaataaatctgtagctccccaaccagccctccttcatcgtaaaatcgaagggcggccacgtggaaggggttgtagagctctggaaggccctcctcgcagtacactggcacactggtaaacgtgccccgatggctaggccgtccgggcagcatgccccgagcagcaaacacgcggcagaccctcgtgagacccgtccggtcactgaagagagtctggcaccaggccccctcgcagtttggcacgcgattggggcaaagctctgccataaccgtgtcgggaacaaataggtgcacgaggaggggggtcccgaggccactcaacacttggttgtcaatgtggacatccatagctctctcatgcgtttggctacagcatcatagcgcttgtttctggtggatttaaataacagggccccgtagacagtcttttgtgagtaaatagagatgatgacatggatgtagagactgaggaccacatccaccaccttctcggaggaggcccccctaaacagcatcaggcagcaagggaacacaaaggaaaccagggccgggatgtgaggcctcagcgccccctcctgatcaaagagggcctcgctgaccccggagatgacattctcattcagaaagtagtgatagaggtgattgaccacagtcttaaccaggccctggacttgttcaggctcccacttgtcccgctggtcctgtgtgtcttgtcggatctcggtccagggcctcagcgccggctggaaatgcggccccatgtagttgcctgtaagggcgcacaccactccctcatgggtctcaatcagggtgcactcgctggatccatcacatacgtggtactcgccacagccccagcaggcaaacacggaggccatgctctcaggtaacgggagatggaactccagcttactatacgagcacaggtggcgaggattgggctcatccgtgcccccctccccccgcgggaggctcaatcggccttggtctgacattccaccccggccaggtccaggagggtgcaaatattctccaggcgctgcacctcagagacctcctgctcaaagaggcctcccaccgccacgtagacgcgggccaccgtccggggaaggtcagtggggtcccagctcagcaattgtccaaattctgtctccccaatagtgactcgcttcttatcctgtctttcagagcatccgggggcagacatttcacctcttgtttgtggacgaggctaactttatcaagaaggaggccctgccggcgatcctgggctttatgcttcagaaggatgccaagattatcttcatctcgtctgtgaactcggctgaccaggccaccagctttctttataagctgaaggatgctcaggagcggctgctgaacgtggtaagttatgtgtgtcaggagcatcggcaagattttgacatgcaggacagcatggtctcatgcccctgctttcgcctgcacatcccgtcctacatcaccatggacagtaacatccgagcaaccaccaacctctttctggacggggcctttagcaccgagctgatgggtgacacctcctcgctgagccagggtagcctgagccgcactgtgcgtgacgatgccatcaaccagctggagctctgccgggttgacaccctcaacccccgagtagccggacgcctagcctcctccctctacgtgtacgttgatccggcctataccaacaacacatccgcatcaggcaccggaatcgccgccgtgactcacgacagggcggaccctaacagggtcatcgtcctgggcctggaacacttcttcctcaaggacctaacaggggacgctgccctccagatcgccacctgcgtcgtggccctcgtctcctcgatcgtcaccctgcacccccacttggaggaggtgaaggtagccgtggagggcaacagcagtcaggactctgcggtggccattgcctcaatcattggggaatcctgccccctcccctgcgccttcgtgcacaccaaggacaagacgtccagcctgcagtggcccatgtacctcctgactaatgagaagtcaaaggcctttgagaggctcatctacgcagtgaacacggccagcctttctgccagtcaggtcaccgtctccaacaccatccagctctccttcgatccggtcctctatctcatctcccagatcagggccatcaagcccatccctctccgcgacggtacctacacctacaccggcaagcagcgcaacctctctgacgacgtgctggttgcgctagtcatggctcattttctcgcaacaacacagaagcacacgttcaagaaagttcattaaactttattgactacaccagtcccttgtaaagcgacgggtctcgcgtgacggcattcgtgagcagggcttcgtccaggggcttgttcttggcggacatcattagcccagccgcaaatatcagaattagcatcagaaaagtgagccccacaaacaccagtgtccagagaggaagaccgtaagataaagatggctgcctctcatctggaacggtgggaagctcagcagttgtttttgtggcattggacgtccctttggaggacagcgtgggggccaaggtggtagcgttggtaatacgggtagtagcactggtggtggtggaggacctggtggtgacattgctagtcacacccgtggaggttcctgttccggcctcggtggcagtgatgttctgtgcagtaaccttagtggtgacattgatggtggatgcgttggaagttgttgggactggtgtgacagttgtcccagtggatgtcaccgtggttgtgttggtgctcaggatagcagttgtggttataggggcgctggtcgtggtcaaggtcgtagactggtttgtgctaggacccgatgccgacggtgatggtgtagtcacagccgttgtgcctgtcacgttccccgccgaggccgtcgaactgccactagatgtccagataaggcttgtctcacagatgagtatcatggccaggacagcgcctgccttgtctctggcgtgtgccatcgcgtctggacgcagaaggcctcccggcctcttttatagctagtctccacacccaatactctactgaaccatcacatacatgacctcctcgaggtatgcagggaatgagcggtccgtgagccggtcaacacgacattgcttccgtttcatgcctccagctgcccctgaccagttaggacccttgacggatgtctttaacggcgcggtgcagttggtcaccaatgacggcctaaaggccaacacatccttgaagcagggcgtaggaatggtaccaaactcggggcccaccccatcaaagacataatatgtctcatagtggcagtgatgatgcatcaccaccacagcactcgccaggaccctctgcatatcttgtacaaggcgcctttcaactcggccactggctctggtgacgttaaatgtcctgttcctattagtcacagcctgtagatttgggcacccagactcaaaaagtgcagctacatgaagggcagccgcctcaaatccaccatgacccccatggctgtccgtgttgttggggtaataagtcacattgttaatgaccacggccgggataagggtgtaaaccttgcagaatggattggtcggacacccataagacaggggcaccccaaaatcacgccccttaccccgaagcaccttggcccccaccggcataaagctgggcaaaaagagtgggttaaaaccaaaggcgagtagggccaggaacgccaaatagcagcagtaatagatgaaaacaaagctcagcatgaaacagcgtggaggctcagctagggtctctgcctctccatcatagacatcttccttgaatctcattctctcaccgcatacctcgctcttcatccaggagggggccatggctgccattctaccagttaacgaggagagagagagtaggtccgcggaaattggtgcccctctctgccctcctgacgaggccatggtgtcatccatctccgcagtccgttcttcagctttggcattggtccgggtccgggtggtctgattttgattctgatcctgggtattggtcttggtctctcctcccccattggcatggattggcataggtgggtgtggctcaggctcaggttccggccctgggacggcagcagccgccgggacggtgaagtcgtggaaggtagaggcccgtccctcccgaggtcgtggggccggagccttataaaagacttccaccctctccccgctggccaagacacgccgctcgtggaccacgccatcttcctcccggctgattgtgtggctgacggtgccgtgttccaccgccacttgttcatcgaccatggtaccccctttatcttaaccagcaagtggccgtcagggtctcttgagagtatgccgctgtggccaagcgaggccccaaattaaatagtgatgccaaagactgtaggtaggtcatcatcacacgcatgcgtgataaatcatccgccactgacaggtcatccaggtctatccgggctatctcatccggcaccatttcctggaagagattcaagaggtcgtaatgctcatgccggataaggcctcggaccaggcgcatactggccctgggcagcagggtcaccatgatgcaaaagtagagactcagattgtccagcagggccaagccaaggggccctggcacctccgggagggccaactcgtagtggtgccccaggtatgaaacagagccaagatgcatgtgtacatcgagcatgtctgcgttcccgggagcctgcatgacaacccgggagtacacgttaaacaggagaatcttctgcagcacctcctctgctatgggcgtaggcagcaccatggggaaaacaatgtccacatcattggactctaacttcacggtggcatgctctcgtccaaataccgggggcataacactgaggctcccggtcccatgccactggaaaaagggctggtacttgttcttaatggcgtaggtctgacctggaacaatcttggtgagtatcaaactgtccacgctaacctcatccagcacggccagggtgcaatcagacaggtagttgtacatggacacgtagtccgggaccgtctctagagagtacacctgacccaagcccaatccctgcacattctgcgtcccgtgagtggaagccaggggtaagatgcagccaatcctctgttgcatcttggcaatctcatcggtatacagacgagaggagagagacactaccactttcaaatccatctttattgacaattatcaaaaaaccaccttatttccaaactttaatattcttcgtaccggcgccacctcttcaattatatagtgtccgtaatggatgggggcgtgggtctgtttgacagacataaactcatcgatgagtgcccgggaggaggctgagagtgcggggaatgcctcctgcagaaagctgcagggctgctccagaaacacgtcagtgccagcaatcactacaaactgcacctctgtgttgctggtggctgggtgccctccaagtcgctggctgtactcgttgaccatgttgtagagtcccctgttgttgcgcagaagctcctccttgttgaaaaatgcccggcaggggctgtagaggcccgggacggccgtctggcgataggaggagttgtacatgatgtcacccagagaacccagctgagatgcccagggattcacagtgctccggtattcataggcggcatccgggcgagaatggtcatagatgagcccctcggcaacctcctgattgtagttttcacaggagaccacacaggcggcccgtccccttggagagttggacttttgaaaataagccacgtctgccgtgaccggtgttacgataatctcacaggtggcctgctggccgtggcagagtcctggagctccattaacattagtcatacctgccaggtatgtcctggggtcccgaagcagcgtcccattgcgctgagcgcccaccttggccttgatgtagtcattgacttgctggttgccaaaggcctcggccggaaagacgctaaagaagtcttgggtgtggatacccatgtcagtagtgatggccgccaccctggccggcgtcatggtcgagctataactaagcccggtgtcgatggaggccatctcgtgatgcacctcaaaggttaccgcgtccaccctggcctcccggcggctaacatttggggtcccaatgaacatggatgttgaggccctggagctaaacaatatgttttcagagaggatctcatcggtcctgaccacggtcatggccacccctgggtggatcttgagcttggcctgggcaatataggccatgggggacatcttgatgtgcatggcggtcattccactgattgaaacgagggaaggaagacattcggccgcgtatttgcccatgggcgagcggtgccactcccggtactctgcaaagagctgctctggccggttgaaggcttccacggcccgctgctgaggattgcgcataacaaaggtggcaacatcctggtgcatggtggcagccactcgcgggtccccgtaaaacatatggaaaggaatggcgtgaaagagacactgggtgacggcccgggtcctctcggagaaggcaaaggccaccagcccgttcaccaaaacagtctgctctgtccgcttgtcggcgggattcggggccagctgctgcgtaacgtcattgtccaccgacacgcgcacggtgcgggtgaaagtggggcaggtcatgaatgaggcgctgaggtccctgatcatgcccacggtggggcggaggtcggagatctccagcagatccctgagcgtcccattctccaaattgtcgagtatgtcctcgtccctggtaaaatgatggctgaaggctggcccgttgtaggccagggtctgggccacgtgctgaaagtccaccccgaggccgcacatgtgggcattggtgcaggtcgggaggaaaacgtagtaaaagatcttttccagcacatccgcatgcccctcatctacataagggcctaggtgcagacggaaatcgtggtcgtggtctccgttaacccggtagccgtacaaggccacaaattgggcagccatctcatccatgtttccaaccctctcaataaactggggcgcggccagggtgtcagcgtaaacctcatttccgataataatctggggggcccggtcactaacggtgagaagatgggtgaaaatgtctgtgtaggccaccggggggagcaggttagggtccaggagtgcgcagacatactgacccacgctctcatcccccacaacatctgacccggccaggcgcatcagggcctgctctagggctataagttccccatagatttttctatacatggaataggcctccttggagatggcgttatttcccaggtggcggcagatgaacttgatcatggaaaagctgttcacaaaggcaagcctccctgcccgttcccagtaggtgttgatgcacagggacaccaaaggcacgttcatgacaaacttttcctcaaacccgtggatcatagcctcgactacgtagaagaaggctggataggcagtgtcataggcagtatcctgcacagtctcaataacggcctgatccaccacgtgggccagagatgtggcggtctcaaactgctgcccccgggcctcttggaatgcagctggggccaggggagtcggcaggttacccaccattagccggtgcacggccctgtgcctggccctctccccggcatccctgccaatgtaaatatcataaagggggtgcagctccagccgcagcaggtcataattggacgggtggaggaagtcttcggtgggcagcccgcacttgagagctatatctgtcacgggggctgcatacttgttatcatagaactcgtccacaataacaagcacattcatgtgattgggcctcctgtgttgcagggagtaggtctcgcgcctgtctcgcggggccggggccgcgttgaggctgtttagggtatgggcgggtgtgtggagtcgggggtgacagagaaccttgagagcattctgtaggttaaacgcgaggagaaggttattcttgtttacgatccatgcctccaccggtagctgctgtgtggggttgtccagcattttgatggcggcggaggtcgtgtacttgggattgggcataaacaggcccactgggaaatagtagctgtactgcattcttctgttgagggggtatggggactgagtgtcattgtacatcttttgcaggctttccacggccaccgcgtggttgcccagcttgatgacggcggctgagatcggcacccggggctgatcctcgacccctgcggccacagccggcaggtcagacttggtgcttccggctttttccggtgagtccacgatcctagccatgaaatgctcaaacgtacgcatcacgcgcccgtagctcacggcagtgaccaggttctccccccgtaccacaaaagaagcatagctcgagggccccatgatctggttgtcggcctcctcacccaggaaggtcaagagctggcgcagaacgttgtcggtgacaataaacaccccccccactggctctccccccttggcggtcgtgtaggtactgacccccttgagcacgctctccccggacacggccgctaccatctcagagagacggcttcgcacgtactgagaaaacccggagcccatgttctcggcccggtccaggaagaaggagtgctccagcagatgcctcttgaacatggcaatgaggtcagacttgacagtcttggagaaccccctctcagtgaaggtaggatccgccagggtctgcaggataaacatgggaggggcgtggcgaagcttcacactcaggacggtgttaatgaggcccctctccagggcatcgaccccaaactgtagggccgaggccacggtcttgacagcccccacgtactctgcgtactcgaccggggtctcggggatactatgcaggatctccagatccagcatggacagttccatttccgtactaatgtggtgtttgtggcaatttttgaccacaatgaatgtccgctgcttgctgggtctccttccgtccccgtgagcaatggtggggacggagattcgaaattgaatcttgccatccgtcatacgactcaggtctttgaattccgtgttcacacaggacacggccagtgccgtctccaggaagcgaacatattggatggcgttcgtgtagaccccgagtagcacctcaaacttgatgcccgcctctctggcatccttgcccaccagcaggtcaaagctatgaaacagcccctcggccgctgactgccgcaggttcgagagcaggtcggcatccaccgtcagataggggaagggtctgttttccacaccctcatttgaggccatgacacaaggtaagagggagatggggggaggtctcgagggcttctcttcacagctgggtctcttttacgccctggcctgcaaccgcagcccacccgcacttcccgaggatgctacccttctaatcaaatggttggacacggccctgggcagggaggccaccttttacgcgtgtcgggctatgcgtcgtcttctactcggcgttatccgaataaatgactgccaggagctgccacctggtttaataattctgagtccgggcaccgtccctggcccccttggagtccagagtctggagcatacagactgcgaaatatggtcctctgcccaccctgaccacgctgcccacctcccggtgcccagggtcatcacatacaccgactgcccgggttccataagcacgagctcaatgtttcgccttatcatccgctacttgtctcatcaccaatttgagcgctgcttcgagcagttctgccgcgtggtcccgcgtcgcttcctagggacctgtaagcaaaactctgcaaagatgctggctcatctgaagcaggttaccaggatccccccctgtccgcccttcagcgggcgggaggccagactcaagttccacttcttctcctggagcacattcatgctgtcatggccaaacaatgccacactccgggagatcaggacgagggccgccaccaacctcacccaccacccacatctagtggacactctgtaccacgcctctccgcagaccccatttctgacacgcagcggtgctctataccgcttcgtcacctgttgcaactgcaccctgcccaatatctccatccagcagtgcaaggccggggacagaccgggggacctggagatcattctacagagtaacggcggagggaggcctgcgagcttccagttcccctcctccccaaccggcgccctattgcgatgcatagttgctgcggccctgctgccagaggtgtccgtggggcaccaggagctgtctccgctcatgtccagaagccatggagggcagacggatgtcaggtcgggcccggacccggcccggaggctggtggccctcctgcgaagggaagatggggcacctaaggacccccctctgggaccgtttggacacccccgggggcccggcccggccaagagcgaagacgaggagtctgagcgtcgagacgcccctccacccccgctcgatttcagcttccaagcttcccggttggtgcccgtggggcctgggtttcgcctgcttgtgttcaacaccaatcgggtgatcaacactaaattggtgtgctcagagcccctggtgaagatgcgagtttgcaatgtcccccgcctcatcaacaactttgtagcccgcaagtacgtggtgaaagagacggcgttcaccgtcagtctattctttacggacggggtgggggccaacctagccatcaatgtcaatatcagtggcacctatctgagcttcctattggccatgacgtcactgcggtgcttcctgcctgtagaggctatttatcccgcggccgtgtcaaactggaactcgactctagatctccatgggctggaaaatcagagcctagtcagagagaaccgaagcggggtcttttggactaccaactttccctcggtggtgtcctgccaggacggtctcaacgtgtcctggtttaaggccgcaactgccaccatatctcgagtgcacgggcggacattggagcagcacctgatccgtgaaatcacccccatcgtgacgcatcgagaggcaaaaatctcccggattaaaaaccggctctttaccctgctagagctacgcaatcggagtcagattcaagtgctgcacaagcgtttcctggaaggcctgctagactgcgcctccctcctgcgcctggatcccagctgtatcaaccgaatcgcctccgagggcctgtttgatttctccaagagaagcatcgcccactccaaaaaccgacacgagtgcgcgcttctgggtcacagacattcggcgaacgtgacaaagcttgtggtaaacgagcgcaagacccgcctggacatactgggccgtaacgctaactttttaacgaggtgtaagcatcaggttaatctaagacagtcacctattttcctgaccctcctgaggcacatccgccgacgtctgggcctgggccgtgcttccgtaaaacgagagattacccttctcctggcccacctgcgcaaaaagacagcccccatccactgccgtgatgctcaagtgtaagcagcccggggcccgcttcattcacggggccgtgcacctgccatcgggacagattgtcttccacaccatccacagccccactcttgcctcggcgctgggactgcctggggaaaatgtacccatcccggccctcttccgtgcctcgggcctcaacgtccgtgagagcctgcccatgaccaacatgagagcaccgatcatctcgctggctcgcctcatcctggcccccaacccctatatcctagagggacagctgacggtgggcatgacacaggacaacggcattcccgtgctttttgccaggcctgtcattgaggtaaaaagcgggcctgagtccaacattaaagcctcctcgcaacttatgatagcagaagactcctgcctgaatcagatcgcccccttttccgcatcagagcaccccgccttctccatggttgagtccgtaaaacgagtccgggtcgatgagggagcaaacacccggcgcaccatccgggatattctggagatccccgtgactgtgctctcatccctgcaactgtctcccaccaagtccatcctgaaaaaggcaccggagcccccacctccggagccccaagccaccttcgatgccgccccctatgcccgcatcttttacgacatcgggcgacaggtgcccaagctgggcaatgcccccgccgcgcaggtcagcaacgtgctcatcgccaaccgctcccacaactctctaaggctggtgcccaatccggacttgctgcctctccagcatttgtacctcaagcacgtagtgctaaagagtctgaatctggagaatatagtgcaggactttgaggccatcttcacctccccgtctgataccatcagtgaggctgaaaccaaggcctttgagaagctggtggagcaagccaaaaacaccgtagagaacatagtcttttgcctcaacagcatctgttccacctctacactcccagatgtcgtccccgatgtcaataacccaaacattagcctggctctagagaagtattttctcatgttccctccctcaggcaccattatgagaaatgtcagattcgccacccccatcgtccggctcttgtgccaaggggctgagcttggcaccatggcacagtttctaggaaagtacatcaaggtcaagaaggaaactggaatgtacacactggtcaagctttattacctgctgcgcatctaaaggaaaaacataacaatcttgtgaaccagaaagatacccagagcaaaagcaataaagtacaggattattgccaaaacaacgtgtgctctttcttcatacaggcccgcaatttccatgacagtcccgttggtggtcagcagcagatagtgaacgtggaggttgtcaaaatcaaagtagttggagctcaagatggagttttggacttcctgggaggtgatgtaggttgtagtttccaggccttccttttcatcataactgagcagggcaaagccacaaaaaatgcaggatttctgcgtcctggtaaaattctggatctttggaatctggcggggctccccagccacagcaccctgcgaacatttattcattataacgggggagagaaagagagagctgctgagataggtggtgctggcctcgtatagcgccgagcctcggacctcacggtcactagagattatgaatgtcacgttgatgagcgggataatcatcagaactttgtcgagcctgtccacgcatttgtaggcggggagatgccacgcatccctgtcttctcgctccaaagagagacgcccaagaaacccatccacagcatttgaaacggccgcctggtccagcattgcctcctggggggccatgctcagcagcttgtctcgtgtgaggtcaaatcgtaggctgaggtagcacggtgagaagagcccgctctccgtccccagggctagcccccgcaaaacctccccaatctctagggccgagcacagggcggtggacagcagttggtatagggcaaggttgggcccctgggtagtcacgttcagccgcaactcgcgtagcaccacgtggctgccgataaacagggtctctctcatcacggtatgcaggggctggaaaagggggtggcggttgtaggccgagagaagcacagatgtggcgcctccaatgaggccactgtaaaccccggccttggggtagccgacggtggctaacctcagcgcgtactcctgtttctcagtcgtcaggtgaccaagctcctccatcttgaccgtggccatcagcacggcggccaagcgctccagcccgtaggattgcatgcccttgacagtggccccataacatatgccgatgatgtctttcaggacagtcagctcaaagaagctcttggccaaccagcggaggtccacgcagccattgccagtctcacccacggcatgacccaccttaaagaaggccacagaaacctcaaacatggtagtcagcgtttccgtgtccagttctggctcccggcagcctcccttcatctccagcaggaccagtttctggagaacgtagcgagcgtagctggcggctgtcatggtgacggctcgggaaaacatatccttcaggttgggtacaaagtagttgtgaaagttggcataatgcacaaaggttgtaacaatcaccagggaatagtccccgctttgggcactggttaaggatgggtaactaaaaggccccctcagatccggcaggtccttcgtcttgccaaagatcaggctcaacacatgctcatctcccttctcggtcactcgcttgtaggtgcccatcagaaatttagaagtcatggcccccgtgtactgaaacttgtccccgttgatggacagggccacataagacaagtgacagcgcagctgataaaagacatagctgtgtggccgcgtgttgggcagcatggtgccaatatagtagaagagctgcttctcaaggggggcactaagcatgcaggcaggggaattcaggccgctaatgactccgggatggaccttagatgcatccacttgcatggatccttcagagacagcagggatatcgacaggctcggccagcgcaataccaagggtaccagacgtcttgtaaattaacttgtagcggttaagcatagacgccaaatcttcggtgacatttgcctctctccacagcgcctctgggctaaggcctgggacctttgccatcagttcggtccatgggatggtgtaatgcgaagcatgcccctctatgtccaggtgcagcttaacctcgctgagactggcagcccccacctcccatagcaacaccaggcaaaaaacacagagcaactgcatcctagtcccgatttcccctctcaaaatcagagatcaccttgctcagaccagcccaatcgaaaaactgagatcgtattgccggattcttcaatgcctgcatgtaaatctccgtccagcatccaggtaaatcgtcctgaaactctgagaggtccacaagcacaaactgaaggtaggctagcgttcgggtgaacgcaagacaaacttccaacaacaccgcgtcggctcggaaaggctgtatgacttccttaagtacactaaagatgctgttcttatacagcttctcggccacaccacttcgaattatgggggtgtggctttgatgacatactgtcgtgattgttgttagaccggcacataccttcacaatgtcctcgggggcaaaatactgtgttaggagccaggcacagtaaacggcgtgatatgcatcgttgacactcttcaggtagccagcatccagtcctgactcatgtttcctccctcgcttcttcaggcggcgcatgttctcctccacgtttaacttcatccagactatggtgtcccccgggtctgcggtaaacgtggccaaaacttgaataaagtcactataggagagaagctggctccggagcagcattagagggaaaaccacggaggccgacagcaaatggcgatcatgcaaaatccaacaatccaggggcgcgactgacctggcaccagactcggtaaccagcaagctccgcttcctagaggccaagactctgaaaggggtagtaaatttcatctggcatgctaaaacctcagccgacgtgtcttcccttccatgcctcgcccgagtcacattcttgtgcatggccttaatggcattttcatacacatgagtccagtaccgcatcggttcagggactacaatggtcaggtccccaaagacagccttcaaatgattcagcatagtagtctttcccacaccaggggcaccttccaaaaatagggaacaggcaggtttgattactggtacatgatttgtcaggtgggtcacaattggaacccgcgtgctctccttcctctgagccttggcctggcgggtgtcttgggcatcatccagattcagaacattcatcacactcccacttagccgcttcagctgggcagcatgcttggataacttactaaactcacgcccatgggcggccaggtgttcgaagagaccagaaggcttacccttgccaccattcttttgttttaacgcggaatgagaagagggcctgcggaaattagactcatcctcagactcacagtcagatttgtcatcaagcccaaggccggccaggccctcctcaaagcctttctggtacatgaagctccggctcgtggagtccgcacctccttctgtgcacgaagttttgcggaaccaggagaaggggtctggcgtcttgctggggccacactcccggctacgtggcttcggggtaggggcagtaggcttttggtgtgcgggtgctggtggctgggctcccctgggtagggtaaaggggcacgatgtgtgccggctacccggagagtttccagtattagatgtcacggcagcctgggtccggcacggcaccctctccccagacagtccggtcggagccatcaaggggggccagtgggtgggcacctggtagagtccgtcatcatcttcctcacctgcccctgagtcactgccggttggggtaagaactgagggggcaaagtcatcaatctcagcgtaaaagttttcgtgtctttcgttttcaggggactcatcctcctgacattttcgccagccgccgggcgggccggcctcctttcctggaaatccagccatggatcccacccgaggtctgtgtgccctctccacgcacgacctggcaaaatttcacagtctccccccggctagaaaggcggcaggtaagcgagcgcaccttaggtgttactccaagctgctctctcttaagagctgggagcaactagcctcttttttgtctctgcccccgggacccacgtttacggactttagactatttttcgaagtcaccctgggtcggagaatcgcagattgcgttgtggtagctctgcagccttccccccggtgttatattgtagaatttaagacggccatgagcaacacggccaacccgcaaagcgttactcgcaaggcacagaggctagagggcaccgcccagttgtgtgactgtgccaattttcttcgcacgtcctgcccccccgtgctgggcagtcagggcctggaagtcttggcggcgttggtatttaaaaaccagcgatccctgagaacgctccaggtagagtttccagccctgggccaaaagaccctccccacctccaccaccggcctgctaaacctcctctcccgctggcaggatggcgctctccgggcacgtcttgatagaccccgcccgactgcccagggacacaggccccgaactcatgtgggccccaagccttcgcaactcactgcgcgtgtcccccgaagcgctcgagctggcagagcgggaggccgaaagggccaggtcggagcggtgggacaggtgtgcccaggtgctcaaaaataggctgctccgcgtggagctggacggcatcatgcgtgaccacctggccagggcggaggagatccgccaggacctggatgctgtagtggccttctctgatggcctggagagcatgcaggtcaggtccccctccacgggagggcgctctgcgccagccccgccctccccatccccagcccagccgttcactcggctcaccgggaacgcccagtatgcagtctcaatctctcccacggacccccctctgatggtggccggcagcctggctcaaacgctgcttggtaatctgtacgggaacatcaaccagtgggtaccgtccttcggaccctggtacaggaccatgtcggctaatgccatgcagcggcgcgtgttccctaagcagctgaggggcaacctgaactttaccaactccgtctccctaaagctgatgacagaagtggtggcggtgcttgagggcaccacccaagactttttctcagacgtcaggcacctgccagacctccaggctgccctgatcctctcggtggcctacctgctactccaggggggctcctcacaccagcagcgccccctccctgcctcacgggaagagctgctggagctgggcccggagagcctagagaaaatcatcgccgacctcaaggccaagtcacccggcggaaattttatgattttaacaagcggaaacaaggaagcgcgccagtcaatagcccctctcaaccgacaggcggcatatccacccggcacattcgcggacaataagatttacaacctgtttgtgggagcgggactactgcccacgacggccgcgctgaacgtgcccggggcggcgggtcgggaccgagacctggtgtaccggatcgccaaccagatctttggggaggacgtgccccccttctcatctcaccagtggaacctgcgcgtaggtttagccgcactcgaggccctgatgctcgtctacacgctctgcgagaccgccaacctggccgaggcggccacccggcgtctacacctatcgtccctgctcccccaggcaatgcagcggcgcaagcctgccatggcgtcagctggtatgccgggcgcctatccagtccagacgcttttccgccatggggagctcttccgcttcatctgggcccactacgtgaggcccacggtggcggcagacccccaggcctccatcagctctcttttccccgggctggttttgctggccctggagctgaagttgatggatgggcaggctccctcccattatgccataaacctgaccggacaaaagtttgacaccctctttgagattatcaaccagaagcttttatttcacgacccggctgccatgctggcggcacgcacacagctgcgtctagccttcgaggacggcgtcggtgttgccctggggcgcccctcgcccatgcttgcggcgcgggagatcctggagcgtcagttctcagcctcggatgactacgaccggctgtacttcctgacgctgggctacctggcctccccggtggccccaagctgagccagttcctcgcactggagtgggtcattggcaaaaaggtaaataaagtcatcgcacgggggttttgcctccttctcgtctcttgtttcgggtaggggagtaaggccgtgccaggccgccatgctcagggccacggcgtgccagaggccctcgtagtcgtgcgcatccgagaggatggcacggtccagaagcagatagccggccaggcagaggaaggccacgaagagggggcgaaggcgtgcccgaacccgggtttcatgctcgtctgcaccccagtggacaaggcagtagaggacacccaccaccaggcggttagggaggacactgccaaggttgaagagcagatttccgtcagccagggtgacctggctcaggtccggcgccctgcgcagtccaagctgcgcccacacacatgcacagacggcccctgtgacatcaggccggtcatgcaaaaacagacaaagagaccgtgagcggttaccggggcgcagggcctctgccgggaagcccacccgggccagggcccggtaaagcaggtaccagtattcatccggcaccttgcgcgccagcacacgattcgtgcggtttccagtatttatcacggcttcccgccacaggtaaaagttaacacttagggtcagcagcttggtcagggataggtgcaaaaacctgagctcgtcctcgcgcagagcgcaaagcggccagttctttagcatcttcaggaggagcccgtgaatcccaggtgtcattcgcgcgtcatccccgcgcacccccagtcccattaacatagcgggcacaatggtgcaggcaccgtctgtatacgtctgcggctttgtggagcgcccggacgccccacccaaggacgcctgccttcacctggatcccctcaccgtcaagagccagctccctctgaagaagcccttgccactcacggtggaacacctgccggatgctccggtcggctcagtctttggcctttaccagagccgagcgggtctctttagcgcagcctcgattacctctggggtcttcctgtccctgctggactcaatttaccacgattgcgatattgcacagagtcagcgcctgcccctccctcgagaacccaagttggaggctctgcacgcctggctcccctcactgtcactggcctccctccacccagacataccccaaaccaccgcagatggaggcaagctgtccttctttgaccacgtgtctatctgtgccctgggtcgtcggcgcggcaccacggcagtctacggtacagaccttgcgtgggtcctgaagcactttagtgacctggaaccgtctatcgccgcccagattgagaatgacgccaatgccgcaaagcgtgaatccggatgcccggaagaccaccctctgcccctcacgaagctcatagctaaggccatcgatgctggatttctgagaaaccgcgtggagactctgaggcaggacaggggtgtggccaatatcccagccgagtcgtatttaaaggccagcgatgccccggacctacaaaagccggacaaggcacttcagagcccaccaccggcctccacagacccagacaccatgctatcaggtaacgcaggagaaggagcaacagcctgcggaggttcggccgccgcgggccaggacctcatcagcgtcccccgcaacacctttatgacactgcttcagaccaacctggacaacaaaccgccgaggcagaccccgctaccctacgcggccccgctgccccccttttcccaccaggcaatagccaccgcgccttcctacggtcctggggccggagcggtcgccccggccggcggctactttacctccccaggaggttactacgccgggcccgcgggcggggacccgggtgccttcttggcgatggacgctcacacctaccacccccacccacacccccctccggcctactttggcttgccgggcctctttggcccccctccacccgtgcctccttactacggatcccacttgcgggcagactacgtccccgctccctcgcgatccaacaagcggaaaagagaccccgaggaggatgaagaaggcggggggctattcccgggggaggatgccaccctctaccgcaaggacatagcgggcctctccaagagcgtgaatgagttacagcacacgctacaggccctgcgccgggagacgctgtcctacggccacaccggagtcggatactgcccccagcagggcccctgctacacccacccggggccttacggatttcagcctcatcaaagctacgaagtgcccagatacgtccctcatccgcccccaccaccaacttctcaccaggcagctcaggcgcagcctccacccccgggcacacaggcccccgaagcccactgtgtggccgagtccacgatccctgaggcgggagcagccgggaactctggaccccgggaggacaccaaccctcagcagcccaccaccgagggccaccaccgcggaaagaaactggtgcaggcctctgcgtccggagtggctcagtctaaggagcccaccacccccaaggccaagtctgtgtcagcccacctcaagtccatcttttgcgaggaattgctgaataaacgcgtggcttgaaagtaaactttattgcgtgttagtacctgtccattcacaggggtatccagcccttgcgccgcctcccccagcccgccagccaccccagacaggagatgataatgatgaggagcaccggagccaccacagcacaagtgattaggagcagggcccagtgcacccaggtggtcttagggcgccagggatcgattggaaaagggcccagggtcactggcttatgcgtgggacgtttagaaacaggccgcctatggggcctgtgactggtgcttgtggtgtgggagactaatgtggtgggggctatggtagtggctgggataacagtaagatgcatacgctgagtgagcgtccggttggcatggtattggtcgtcttcttcccctgcagagtaattgcagtggaccccggaggccacactgcaatttctcagcgtcacattgcacgtgtagtaacctgcatgcgcaagggtcacattggggattatcagagagacggaggtgttggagtcatttacccattctagggtaaggctataattgtaacccccgttagttatatgagttccgttgttggaagtagctacggccaagggcagttgtccatccccgggagtgtatccccggcccaactcgatccgagagaccgactcattgctaggaacgctgcaggtgagattcactctagcacctgcatgggcggtgacattttcaaatttaaccagatctgagaaaaatgcacaaacagaccccacacagcagcacaatagaagcactaaatgagtcattcctaaactgtcagttttaaaactccctgcttctcaggcctaaatacgtggtggggtgtgcttaggatcactttcatattctgcaacaacagccatacccggaagaggagctgccggttgccatttttcaagctgctaaaccacgagtggcagcaggcctaagaagctcctcagcaacatggagacctcgaagggaaactggcaggagcagggagtcacgtaggcactagcctcttcatgtgaggtaagagatcgctaaaaatgggatcagggtatgtaaaccgagttttgcgggggatggtgagccagacacggcgggtggggggaaggagctgacacgagtgcgtagaaagggccaaaaatacaccagctataaggaattgctcagaccaaagttgttcctcaggtggctttaggcctaatgtaggcaattgcgtgcctagaacattgctaatgtgccctgtgtttcctgccttcatgcaaatatcctacctcccccggcctggtgcaaaatgtctgcctcagaatactaacagctaatccaagctaacattctatcagtaaacgggcagaaaactgataaggaccgcggagtttggccctccgcggtgtccggtggtcctcacacgtgccctcccccccccgggccgatggctgaggcccggaatatgcaagtgcatctttctaaccagtaggggcctccacctaggtgctttgttaatctttagtgggaactagtgggagtgctgtgcctagggtacccctatcctataggtcctaccggagctccttgccttgataatccctgtaaacacacaccacctaagaacaaggcatcgttaacctttggtggaacctagtgttagtgttgtgctgtaaataagtgtccagcgcaccactagtcaccaggtgtcaccggaggctacttgcctcagtgccacttttaccttctcaaatctatacggggggggggcctctgtaacatttggtgggacctgatgctgctggtgtgctgtaaataagtgcctagcacatcacgtaggcaccaggtgtcaccagggctacttgcctcggcatctcctcaccggagaaggggttaacaaacccgtggggggtcttagtggaagtgacgtgctgtgaatacaggtccatagcaccgctatccactatgtctcgcccgggctatatgtcgccttacctcccctatatagtcacgaccccaccgaaccaggcatgatgtagaataaaattttatgcatcatcttctaatctgtgccgcttggagggaaacatgaccacctgaagtctgttaaccaggtcagtggttttgtttccttgatagagacacaaggactgccagccccgttggggagggggtggtgggtacgggagagtttgggctcgtctaaacaaagcctcctctgatgctctgtggcacctcaaggtgaatatagctgcccatcgacgtatcgctggaaaccggtgggccgctgttcacctaaagtgacgcaaggtctgtcagccgccagggtccgtttaccaggctttcaggtgtggaatttagatagagtgggtgtgtgctcttgtttaattacaccaagatcaccaccctctatccatatcccacaattgataaacctccgcatgtccaaccaccacgttgaacaggatgtggcaccctaagaggacgcaggcatacaaggttattacccagtccttgtatgcctggtgtccccttagtgggacgcaggcctaggtagcatcatttacactaaaagcagtgaccttgttggtactttaaggttggtccaatccataggcttttttgtgaaaacccggggatcggactagccttagagtaactcaaggccaagcatttcacacctgcaaatgcaccatgtaaccacagatctaaactgaaagttgcagctttagatggcaaggaaacttgggtttcaggcatagaaagcctggctcactatagcagcccatgtttgttccagggtgggggaaaggcacgtgcccttagaaaacttagctgcaaaaattctattgtgttgggagagcctctatatctaaaggcctttcctcccaatacaaatgttactaacatctgccctctggagacctgctatgtggctagacttatggcctacccaagacgttgggggtctcgggtaggccgattcttccaggcataggttacaaccagtcactgctatcaagcctactcagttcccaacgcagcacataccccccgcctctcctgccatgaggactcatggcagtgtttactgttctgcttttactcttggaccaggccgtcattctatcagaataacaggggaagcaatgccccctgcgtcagcgggacacgtgtttctagaatctcggagccaataactacctgcccctctaatctgtacgctgcatgaaaaaccacatacacgtgatgtaagtttagccagtttattgttacaccaatgccccgaaagtccccccctgtccctttgggtctcaggacccagccctggagctcggggggcggccgggtggcccaccgggtccgctgggtccgctgccccgctccggtggggggtggccggctgcagccgggtccggggttccggccctggagctcggggggcggccgggtggcccaccgggtccgctgggtccgctgccccgctcccgcgggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcgggggggggggcgctcccaggccggaccctggtgccaggcagggaccccgcgccacccgcttcatggggggggaggccgccgcaaggacgccgggccggctgggaggtgtgcaccccccgagcgtctggacgacgctggcgagccgggccagctcgccttcttttatcctgttttttggggtctctgtgcaataccttaaggtttgctcaggagtgggggcttcttattggttaattcaggtgtgtgattttagcccgttgggttacattaaggtgtgtaaccagctgggtggtacctggaggtcattctattgggataacgagaggaggaggggctagaggcccgcgagaattggggtaggcggagcctcaggagggtcccctccatagggttgaaccaggagggggagaatcgggctccgccccgatatacctagtgggtggagcctagaggtaggtatccatagggttccattatcctggaggtatcctaagctccgcccctatataccaggtgggtggagctaggtaggattcagctaggttcctactggggtacccccctaccctaccttaaggtgcgccacccttcctccttccgttttaatggtagaataacctataggttattaacctagtggtggaatagggtattgcagctgggtatatacctataggtatatagaacctagaggaagggaaccctatagtgtaatccctcccccccctacccccccctcccttacggttgcctgagcccatcccccaccccagcaccccggggtgacgtggcaccccgcgtgccttactgacttgtcacctttgcacatttggtcagctgaccgatgctcgccacttcctgggtcatgacctggcctgtgccttgtcccgtggacaatgtccctccagcgtggtggctgcctttgggatgcatcactttgagccactaagcccccgttgctcgccttgcctgcctcaccatgacacactaagcccctgctaatccatgagccccgcctttaggaagcaccacgtcccggggacggaagctggattttggccagtcttaaattttggggagtggttttgtgtgagccggaagttggcaatggggtgagggtggcgctggttaagctgacgacctcccaaggtctctcaccctgggtacacaggtggggcggcagcctctaactttggctgtggcctctatttcctccctttcctagccagggccatgtgttcctgcatgtctacttgcctcctgtggtggcagagcttggccctgggcccaacccccgccttgggagcctgtaggggccaacacccttggtttgtttgtgttcctgtttgctggcaacttactggcagccgagcagattctaatgggcgcccgccttctttctctcttgttttattaatagaatctcagccaggacctatacctgagacttcaaagtctggtcctgggttctgagacccccaagatttgtcatgcacacctgcacacctgttggtattgggtttctattcttgagtgtgaaagtttgtaaaaaaattcataaaatgtcactaattcctcttacctgtttagagtattgtgcaattcttcagcctgcctattttcaatttgcctaaggtggcaatttaagatgtggttaattaaccattttcctgtctgacaccactgcatgggcaaccgggttccatggcacatttacagataaacatagatgtcttgtcttgctcatgtgcagaggagggggtgttggtgtgcaatatagtttctggattccaaaatgagttgggggtgctattttcactatggaattaaattactgacattagacagtggacaccgggctatatgtggggatgtctgtggcttgtcatttcctcttagaaggtaatcccccatcttaacttccctttaaattgtgatgcaagccctgggttatttatagaatgattatctaggtttgatagtctgaaggctgggcagagaatgtttgtaatttttattcaccttctttaccccccacgagtatccagttctagaaaatctcctgatatcccgggctgccattattcccttgagtgttatagcttcctcttaacttaagcaagagctccaggatgttagcttttttggtggggctggttgtcaggaagaggttccagtgttgtcctttatttttagatgttagctttgtgttgggttagtatgggctgggtattcactagtgaaggcaactaacacagctagacgtgctagttgtgcccactggtgtttatccggtcccaaatgtcacaacagaacacaggaggctggatttggcagcagcacgtgtgcttttgttgatttttacccttgtatcagagtgggggatgcttctggttcctggtcttctctgtgcacaaaaaggggccaatggccacggccccgcggctttttgtgccggtgcggagccaatttagcttcccctccccttagcggggggtctcgcggggtgccaattgtcgcctgccttcccctgcttccccttgttaacttatagcatgataggtaggtcacctaacgtggaagcctggtgggtgatccttcctcggtagggagcgcttagggctgttgagctcaacagccccacctgggtaaaatgtatgttctaaagagttacccaattataacaaaactgttgtagggtaacgaagacctgatggaagtggtattgttgccgttgaaagacgggtgtcctggctcaagttcgcacttcctatacagtgttaaagccttgtatcggaagtttgggcttcgtcccagtgtactcaataatgtcgactgctgcgaaggtttggaccgtcttccagtaggtgttgggggtcccaaatcacgaggttaggcaggtgcacttagctctttaggagggacccttaagccaggcaatgtagtgccccttttttttgcaaattggccttattattaaattcttgttaacactaattctgttctatgaccctgtgtttttcagatgccgttggacgtgtcactgagctgattttggacgcagctacttgacctttgcccccgtgcctccaacgccgataagtgctgcttccactttgtgttacaggtgggccaaacctccagaatatcaagtggtggggccttggtgggctgcataaggcagtaggttttaggtgacctacttggaccatgtggatccagtgtcctgatcctggaccttgactatgaaacaattcttaaaaaatgcatcatagtccagtgtccagggacagtgcactcggaagtctcatcatctccgtttgtgtgtttagtgtggccagtacggccactcctgtgccacgccctggcatgctgctgacatctgggcgccaatttcagcgggcccttttcccccttgttcaccccatagcaagaagggtaggttacatgggtattttcccatcagcacctgactggccggtgtaattagaggagagggcaacaacgcaaggctgttgttttatttgggttacaagagctgcggtggtcgatgggttcactgattacggtttcctagattgtacagatgaactagaactgtcacaatctatggggtcgtagacagtgtgcttaccagacttccatggaagatgtgaatttgctgctagctatatgggtggtgctatgggctccctagggactcatgtagtggggctttgtgatagctaatgaatgtggcagctgttgtttgtactggaccctgaattggaaacagtaacttggattctgtaacacttcatgggtcccgtagtgacaactatgctgaatatcttgaatatgggaggaggggggctttgggttccattgtgtgccctttcctggccaacgtgagggtcctagtgttatagggcgtggcagttttcttgagggctaataacccgggtgaggcggttgtcacaggtgctagaccctggagttgaaccagtaccactcggttacaaagtcatggtctagtagttgtgaccctgcaaagctacgtggggatgagcagccagggactttggttggcaagcagacaggcggcgcattggaaccccagaggagtgtcccggggccacctctttggttctgtacatattttgttattgtacataaccatggagttggctgtggtgcactccatctggtaagggggctggtgcggacgcctgtgtttagtctatgccaatgtttacctgccttgggttactattccaaacgaccacacctttgaggacacctggagccctgatcattctcggcttttactgccacctggcttctgttgggtcagacagtttggtgcgctagttgtgtgcttagcagcaacgcacaccaggctgactgccttagcagtgtggccctttattgtggcatcctaaggagggattctggagtgcctttcgcgtgaagcatgccctgagacgtactcgagttaggacttaatcgctcctgtgccgctggatgagggagcgccaatttgtacatcctagctctggccatagagttagcccacccttgtgtctccctttggcctttgcggtgccaatttccggtggtttcccttttccgcccgtttatccaatagcatgtaagagaggttgcctagatttggcaactttgagggaacgttccgtgtagctggtgacctaacacccgcccatcaccaccggacagattctgaacttgtcctgtggtgtttggtgtggttttggggtacgcaggagtacgttggaatgctttggagccgagagggatgggcccgcttgtgcgcttatgtgttacacggtgccaataaccggcccggtgcggctgccccgtgacccgtgggccttaccttcctggccatcgggggaccctggtgctagggtcccttgtgttgctttctgccataggggggaaagcatcgccttcagaattggctgctccgttggaacatttgaggcctactgtatccgtgtcctgacaacattccccgcaaacatgacatgggttaatttaaacatgttttgtttgcttgggaatgctcttagggcctggaagcttgtcattggattcatcgtttcctgaactacaggcgtagggcctattgtagcaggcatgtcttcattcctgcgtaccgaatggcatgaaggcacagcctgttaccattggcaccttttttccatgtaaacctccgtgatcctgggtcctttggagactcaagtgtgaatttgttttggtgttcggcgccagggcatctcgacgttggaatgtcaactcaacttgggcacctcgataaccggctcgtggctcgtacagacgattgtttggctctgtaacttgccagggacggctgacgatgtgtttagtctgccacttgcatccggcgctttggttacacgggagactaatggggggtgtggtatggcacaggctgggggtgagtctggggatgtccctgggcgttgctgcagcccattcgccctctggggatgagatgttcaggggtggccggtaccctacgctgccgatttacataatataaattgtaaatgctgcagtagtagggatctggacgcgcgacctgctactcttcggaaacgccaacccaggagcgtcgcctctggccccatactcccgccatgcgactgctcgccccctcccaggcctccctggtgagcccttgccgctccccgcattcctgctttcggcgcccctgcggatcccgatgacagcaggcctttccttcccccgttaatgaaaagaatgacagtgaggttgtgacagaaggacagctttattcagtttacagagtgccctcggaggctacgatattcccgttaaatgtcttgttgattctctcaaaggtggggagggaggagctctccacaacaatgttccctggcagcgtgagcgcgcagccctgccgttggatgtatcttctcatgatggtgctgatagaggggtctccggcgtagatgaaaaaggcctgggccatgctctggccggtcacgatcgttatggggttgttggaaatgttccggaccgtcagcttgagggtctggcccggcttccactcctgtgggtagacgtagaagaccgggttggaggagtgggacacgacaacggccgtaatcttggagctcaggggggcctcgtaggtgttgttgtattccagctccgtgatgaaattaggaggaataatcacaggggagccaaagtagcggatgtctgtggattccccgtcccagcgccagtggctcttagggtaggggttgtaacggaaggcaataatcacatcatccaatagggtcatgcccaccttgacgttcagcgggccctctcgtttcaggtccggcgtgtccacggagactcggacgtagcccttaccgcggcgtatggcgttgaccggacacaccttccccgggaatgtgtgaatacgggcgtatgactttagaaatgggggcgtgtgctgcgccagcaggtaaggcaggcactcgtcctggctggtgacgggagagccactgaggaagatctggggctcgctggtgtttagcttgtccccactctgggtgcaggagcgtgtcagctgaatgtcgctctgcccgggcagaatctgcaggtagaggtaggggttcttgaccaatctgatgggcacaatgtaccaggtaaacttccctttctctatgaacaggctgcgcggattcaggacgcttagcacgatgtcctggtcagagtgcataacgaagaagggcttgaggaatacctcgttgtcttccgctccaaagaacaagaacgcaaccgtaaagtagcggctgccgtaggtggtcgtgttgaaggagaaagaaggtaacttgaagctgagtatctggcccaccgaggggcagggaggcagctcttggcactgcgcgtccagctgcaatacctgcttgttggtgacgcgaacgtatgaggggaagatctcgtacttccacacgcctctcatgaacgacgtgtctggtttttcagtgggccgcaggcggcggaggctgttcctgaacgacgagcgccgggacgctagtgctgcatgggctcctccggggtaagcttcggccatggccggagctcgtcgacgggcaaggtgagagtcggggggcgggcgacggtgcggccccaatacaactctccgctcgttagctggtagaatatccgcccggcgtctaggttgtcacttcgctcggccggccagaagagcgcaagtccaagtctggtgctggggccgatgtgcagcggtttgtgcccgcagttgtagactgtcatttttatgggcgagtgggcggtccacacgcgcgggcgcagcacccattggtcgcacgccgcctcctggaatgtaaacccccagagagagggcgtgccgccctggagatggccctgtgccatcacatgtatttcctccttgggtggaacgacggcgtcgtgctccgggtggagggggaatagcgtccaggcatctttcagggtcacgagaccggggtccatgcttagaaaacagccctcccgggcggtgggcggcccgggctccagcagaacgtcgcagacccagccctcctcggccctgtccacctgtatgtccaggtgcacggacccggaggctgcgtctcgtgacatggccaggcctggtgccagccgaccacgtcccgtgtcccagccgaggccgcgccagagcagagcccgggactgactcagggccacatcccctcggcccgcggacgctgcctcgccagcccccgggccttcatgggcccgctttctacctctctccggcaccccagcctggtcagccgcagaggaagcatgaccttggggtgggacggggcaggcgtgatcctgggcgcaatctttaccgatccccacaccttcactccttgttagtttgatagaatgtcggtaccacgccacggggggcgggcccgcatagggaaaagccagggagagcgatatgggcgaggatgggctcaggcggccccagacacgcaatttgcccccctgggcggccgcagcctgcccctcggcggcccgtgccccagctccgtcacggggggcgcataggaggggtatatctaggatagccgcacctacacaaatgagacacagacacaggtcgtgaggatttaggcaacgcaggcttgtctttatagttacaaacatgggagcgtgcacctggaagatgcagctggggtagatctttacatctttacagggcgcagcggccgccagacactgaagggcagagttcacggcgggcacctcccagagggagcccaccagcccgtacctggccacggccagggcctcgtaggccgagacgggcagccggagcttgtggtactgtccctccggcaggtggagtgggacacagttagagaacattagtcccctggtccctatctccacccgccaggcatgtgtgtcagtttgcagggccatcctcgcgctcaggtggactggctaggcacccttctgaagtatctggcggtgactgtcacctggttcttgagagagtccataaaatggctgaagctccaggcgtatagtataatgagcaacagggccagacaggcggcggggcctgggtagtagcgggcaacgagagactctgtgcaatcaaaccccaggctcccggcctcacccaggaagagcagcggcagggacagcataaaccaggagaaggcgcagatgagtccggtgaaggtgacgttgcatatcaggcgcggcttccttccgaattttgtgcgcaaaagtttccagatgatgatgactgtgaggaggacgatcaggactgccgccagtaggtagcagccggctttcagtccttggacggccgtgtgcatgcctttggtggggccttccctgcacatgttggggcctctgttgagattggcgtcggggcccatggtaatgaggaggatgataatcagcaggagtaccagacaaaacacgcccatcaggtacaggcacacatttctgtgggaggttcgcttgggcgttcggctgaacaatgctagggtcttctccaacgccatacccaagtgagtccatacggagcacatcaggcccaagaacatcatgttctgggtcaaaaggcagagaccggtagacgagaactcctgaatcatttttcccagcacccagagcagcagttctatgagaagagctatcagccagacatccattcggtgaaccaattttcttacaaagatgataaacaagatgccagccagtgttagcagaatcagcaggacgagcagcaggcttgtcatgccgctgaggaaggcgctgtaggatttagtgcacgcatcttccgttgcattgacggaagtcatgttggccaccagggtccccacagtggacccgggggccatggtggagagcatcttgctggtcagagccagactgggtggtgtctgcagcaaaagaggaacttgcccaggcagtcagttattttgcatgccacctccctgcctggtggacttccagactattttctgcattcgcccttgcgtgtccattgttgcaaggagcgatttggagaaaataaactgtgagtttcacagatccacgggccacgctcccctgggggcttcatgatcccaccgcctttcccgatgatgatgacaaccgcggctgtctgaagcggctgacgaaatcggttgagattctgatgagaggcttgggggggtctttgccctcaaggcgaggctccttctcctaggaatgccgagccccctgcactagcttcgctccactggggatctttgccagccttcatactagattcagcgatcccccggttgggaatcttcgccagccccccgtcctgctatcccgctcgtcgccgcgcctcccatgctaagggcccccttcctttcccttgactttggggatattcggagtctgctctcgccgctctcttctctcgtttaaacgagagaatagtagtagggtccagtctcaggccccctcactttgggtcttagaatggtggccgggctgtaaaattctggaggacggagagggcggccccggagttgttatcaaagaggcactggaggatgttggccgctccttggagcagcttgtcgaaataatgatccacggccacgggaacgccgtgccgctcggcgtaggccgggtcctcggccatctccgtctttctcgcccccttcactccccccttgggctccacaaagacgtactggatgcggtcgtggatctggggcagttcctcgttgcgctcgacgaacttctggtagacggccaggtgaggcatctgggtgctcttgtaggctgagagcttgcggctgagctccgttgaaaagcagagctcccccatggggaccctgccttcacggaggtctgtgtaggcctggtttaggatgtcaatgacgggcaaaaagcccacaggtagcccttgtgtaaatgactcttggaagggccggtgggagaggaggctggccgcctcctttacccgggcatccgccagcaccaggtcgagcacgcgccggcagcgtgtctgcacaaacttgcaggccgtcttccggacgagctccacccccttcatcagggtcttgccgtccgtcagcacccccacatatctcttctttgtaatcagcatcaggcaggagaaggtcttctcggcctccagggagatgggggccacaaacaggctccgggtggtgtgggcggccagggcctcggcaaagcgcagggtctcgctctctgaaaacccccggcactcgataaacagcgagtccgtgtccccgtagatgactcgaagctggccctcggggttgaggggcgcccaggcgtctggggagggggccagggcctgcaggttggcggggctcagggcctccacgaaggccttggcccgctccaacatcgtgcggccctgcagcgtcaccgtctcggcgatggagaggcagggaaagaggccgttggccaccccggtgaagccgtagacggcgttgcacgtgcacttgatggccagctgctgcttgtcgaggatggtcctttggcgcggatcctcgcaggccgccagcagcttcttgatggccttgcgcttggccagccaggaggtcaacagactagccaagaaggactcgtgcacgtgcttcttcacaaagtggtagacgccccccgtgagcctgaaggactcatagtcttctcccgggcgcaggccggctagcctgtgctcttctcccggcgttatcatggtagaataacagagattatgagcctgaatgatgctcgggtagaggctggcaaagtccaccaccagaaccggggagttgtagaatccggacaggggctggatgacggtggccccctggtagccgtcccggtcagaggccgagggcatgggcaggataaagttttccttttgggcggccgccaggaggcaggagaacacgcggatctgctgcccatcgtccagcacccgcctgcaggggatgtgagcgatcttggcaatctctgccacctccacgtggatcacgaaatggtttagcagatccatgaccagggccgagtcctgcacgcagtacatgccgagccgcctgcgcccctcggggcccgctgcaaagaggcgaggaatctccttgtaatgcacatcctccttcttggcccccagtaggtgcctggctactgtgtccagcttgtagtctgagagactgagcttgtcccggcacacggcgtacatgtctatggggatgaggccggtgatgcggaccttggtgttggcccgcaagaagcccttgcccgcatcatggggtcgcctgacctcgcagacgcccccagccctaattttgcccagagaggctgggttgatgctgtagatgtgcctggctctgtccagaatgtagggccagtcaaagttggccacgttgtagccggtcacaatctccacgctgaggtctctgatgagctggaagaaggcgtagagcatgtccagctccgatgggaactcgtagacctcaaccccctctatgtcttcgcaggtgcccagcgtcagcaggatgcgcctatagcgcccggcctcctcccctgtcgaccagagaacgcaggatatctgcaggatcaggtcagcctcgttggtggccgtggggaagccctcctcccctagacactcgatatcgaaggccagggcctggtaggagggccaggagctgtcttcacgccggaccgagaggtcgcccacctcacagtcgtactcgagctcggcgtacgagtcccggtgctggaggcgggggatggcgcggcggcagctgtaccagccaaaggtgacaaagtcattgtccaggacaaagcggcgcgtggcatccacgttggcctcaaagatccgacacccgtgcttgtcttgcagccacgtggccacgtgacacacactgttgggatgggagagggtgatcttgtggtagtcgccggcatggttgccgtagcccataatggaacggcgcgtgaccttctccaccgagacccggcagggggtcctgcggtcgaaggtgctggccttgagggcgctgaggactgcaaactccacgtccagaccctgaggcgcgctggcgtagaagtaggcctgctgcccaaacacgttcacacacacgctggccccatcggccttgcgccggcccagtagcttgatgacgatgccacatggcaccacatacccctgtttatccgatggaatgacggcgcatttctcgtgcgtgtacaccgtctcgagtatgtcgtagacatggaagtccagagggcttccgtgggtgtctgcctccggccttgccgtgccctcttgggcacgctggcgccaccacatgccctttccatcctcgtcaccccccaccaccgtcagggagtcttggtagaagcacagggggggctgaggcccccgcacatccaccacccctgcggcgcctggtgtctggaaacacttgggaatgagacgcaggtactccttgtcaggctttttcagaaggcctttattaggtcttaggaaagggttatagaagagtcccccagacatggttaaaactcagtctctgcctccccaagcagtgcggcggcggtctctggatcgtgatagcgtcttctgcgtaggcctggaaaacggtccctggctgcctgcaatgctctgctggccactgagggtccggccgccctctgagctgctctcttttgctcctggttttgctcatgcagcgctaacatgatggcttgtaattctgtcttactaatgggattaatgcctggaccctcaccagaggcatgttgctgagcgagctcgtcgatcccggggtagagcatctgcaccggctgctgcgacatctggcgcgtgcgcctcgtgagggaaataaccaggatcaccacccccgccaccaggaccagaatgagcatgccgccgaaggggtttttgaagaaggagatgaaaccagagaccaggctgctaaacaaaccccccaccgtgctgactaggttggtgatggactgacccacgctacccagactgtccataagttcccccaggccgtccacgaattgatttcttccgtttgacactgcattgtccaaatccttccgcaggccggcgatgttttgcgcctggaagttgtactcccggaagatgccctccaggtcaaagacgttggaggcacgctgttcgtcccgtgagtacagctccagggaggcaaagtcaatgttctcgatgagggaggtgtttagtgagatgaaggtctgcagggtggcaatgccgtccagctcgatggttttaaagtggtggtagtcgttgtagacgtggatctcgttgccggactggaagtagtactggctggtcgcctggcacacctccgtcatcttttttgtgaggaagatctcgttgtcggtgcccagctgtccctcgtaggtcttggtgtcgttgataaagctgaaggacaccagggggcgcgagtagcacatggtctcggagccagggaccctcatgctcttgcgcagggtgacggtggcctggttaacgggcacgcactgggagactgagatgacatcccccaggcgcttggccgccaccgccttaccgtagatgctggacatgacggtggtgggattaatcttggttagttctctcagcaccatgttctgcctcttctgctccaggcaccaggcccgcgcgaggtctcccagcatgcggttgatctggcggcgcagggaatcgtaggcaaattggatctggacggtggcgggattgttgagggtgcccagggacttcccgggggccgcggggggcaccggtgtggtggcattccccgcatcccgcctccggcgcctcagaacggcggcggaggtgctcccgcgggccgcgggtggggcggggggcgatggactgctggggggtgaggaagtcggagtggtaagctccgtcaggttcttgacggtggccaacgagcgcggggtcagaggtagccaagctaataacaatcctccgctcgttataaaatatgtaatggcttcctggcccttcgtgtaacgatcctggacggcctcgtacttctcatgcatggtcttgttcacctgctcttcgatgcacttgaaggcgtccgggagctctatgcccacggttgtgttggtcacgaagctagaggtgccctcgtcagtcacaaaatgtattgacttccctgtttctgtggcgatggtcgagtcaaaggtttgccagtgttgaagcgggcagtaggctgtcctgttctcgagcttccaagatagggtgtaagtgcccttgtccaggaaggctcggcgttcgccttgcgggttcgtccctcggttgtcgtagtccactatcttgtagttagttctcacgtggaaggagtctgcccgctcatggaaggtttccttatttttcccgtcatagaaaggggacatttccacagtctgcccggtggtggtcacaaagaagtcgaaggggctgttggacttggccatcatgtcagttatcaggcagttgacggtagttcttgttctgtaagtccatatcaaccacccgggggcgtcatagagctccgtctggctggcgtagcggcgcaccccgttggccaggcccccggtgggctttaggttgacggtgatgttaactccgtcgcggtctacatacacgcgcgtcagcccatcttttgtcatcttgaccgcgttgtagcactggtagatggtatccatctggtcagtttcgtagctgtcaacggagaacttctcctcgtgccggttggtcacggagtccgcgtaccagccattgtagatgagaatgttggtcactatcttggtgtaggagcggaccttaaacgagtagggaataatgttgtctttaaacaccatcaacaggccctccgtgtgattctcccgcgtgccaaacgagggacactggatgtccgaggagaagcggaacaggtcgccgtggctggagagctcgcagactcggaaaggaaagctggtttgctgacgcgtggcggtaggctgcaccgtggtggcggggggtgcgggctgctctggggtctgcgcaccgaggcggcacgccagggcggctagcagcacgaccacgcttagcaccctacgccgagtcatctctcatttggaggtgcaggtagagaagggcatatagatccttaaatacccaccccctgcccttatacagaagaattaggggccggtcagagtcgtacgtgaggtaaagcccatccgggggcagggcctggccggggctgaccgcgtccgcccggcgcaggatcaaggaccgcccccaggtcttgttgtagagggacacggttaggacggcctcgcgcagcgcccggcacagaatttgctggctagatgccagtgagcccccgggtacgctgtagaagctgttgaaggaggtctctatccagtcgctcggctcgatgcctggccatatcagggaagtcaggaacgccttctggtgaggcagcgtacctgcggcgtcacagcagcgagccagggccacgttgctgggtgggggaaagagcccgctctcctccgccaggggccccgtgatgaaggtgtacaggctgtgcgtcagcgcgtgcaggtgctccgagctcagggtctgggtaaacaggtgtgttttgatgtacttggaattctcaaaggcggcaccctcgccggcgcgcctgtcctcccagggacccgagacgaaggcccgtctgtagaggaagtggttgcgcatgcgggccagctcccagtagaccacgtccccccagacgcgcaggcacagggtctcggtcagggtctcgctctgttgcgccaggcaggactgcagcttggccagaccctcggtggccacctggcgcaggtactgctccttgcgcttgagcgcgtccgagagggcgccggacgggccgggctctcgtgccccagccggccggggcacctccgggctctcccgggacgcctcctcctcgcctcggcccaaccgctgcatggctcggttgagccgcgtgtagagctcgttcctcttttgcaggatggcccggtactgggggtgcgccgtgaaggcggcggcgcagtccgccttcagcgcctccaccgcgtcgcccgaggagctgtagaccccgccgcagaagagccgctccgtggccccgggagccacggcatcaaacaggtgagtcagccttgcccccgccagcgcctcctcgcaggcccgccgcaccagggccaggcgacgctcccgggcaaacagggcagagaggcgggaatggccgccaccctccccctgccccgttgcaccgatagcatggccgccagagttccaatagaggagctccgagagttccgccacctccgggggcactgtcgagaagacgttgtaggtgtccagcgctctggtcgccccctctgcctccggccgccccgggcccgggaccgcgccctcctctgggccgcccggcctcgccttctcctcagcctccaacaggtgcccgagcccagcctgccggacttcattctcaaacagtcccgagaccggctccggattcaccggcaccgccaggtggttacaggagacgtgggtcccctctgccgtggaagggttgccgtggttgggcagaaccatcagctcgcccacacagcgccagcagggcacagaggtgatgtagaggcgcgggtctgggatgggacttacgccccgaaagcggcccagcagatccagggcccgttccaggctctccagccccatggtgtgagacatgcaataaaacacgctattgattctcttcattaaaatctctatgtcatttattaggcacaaacttacatcgactttatgccccccgtaaaactccacagagtacgcgactgagggggtgcggagaggcgggacccgggtaccctttctaccaggggcgagcagcgcggcagaggcctctctcgagttctctagcaggtgcaccagctccagggacagggcgctgcatgcacggtcattctgccgtctcaaacggggaaggaggatggcctccagctcggccagcaggccggcgttgcgcactaccgcagccacgtccagactccgggggtccagccgggcgcacacgctcagctcaaccgccagggcgtacacctggctgtacgccgccgccagcagccccgacatcgccgccccaggggtctctagacctcgagtccggggagaacggtggccagacggcgcttgcgtctgcccccggagccctgccctcctccacccagcagcagcccggccgaggcctgcgacgcggtgctgaccggctcggccacgctgataaagttgtcctgggctgccccgggcccaccccacactccctccagaaagtcccgagcggcccccgccgtccactctatcccgctggaggcaatggtcgccagggtttctaggacgctgtccgccaggacggagaagcggcccaataagtactccgcgtcgtccctagtcagcgaggcgcatgcctcgcccatggcatccacaaggttgcacaccacatcaaacacacagtcttcctcctgtttttgtgatataatggcctccaggccagccctgatgttctcaatctcatatgtggtcgcggcttgggtccggcgcttcacggtcaaccctagggtgggggtggcaaagacaaacttcttccgcatggaagagcccccggcctgcttgcgcagcccagccccgggggcctgcagcaggttcctgtccacgccccggcccataaagtatcccaggttcccggcctggaatatctggttgttgccgttgacccccgtgtacttgttgatggtcactggcagcgtgacaaccggacgggccttgcagacctggctaagacagtctgtggccgcgcagaccaccgtagtcgcagtaagggaggaggtggcctccgcgtaggccgctgccgactccaccgcccgcgtgcccagtacgtgggggtagtcacgggcgggcaccgactgcgtcctcggcaccagtccctgaatcaggctgatgtagaactgggtctggccgcacgccttcaggatggcgttgttgagcctctgcttggcgtaagtgaccaggttgccaggcaccacatctatgacgttgctctcttcgtgggcccgggagcccccgtccacaaagagggccaggtcagagtactcctccgcgctggccccgctggggacagggaccgagcgccgcctggaaaagttgtgccacaggtacaggcttgagagcttagtgtccgggaatagggtcttgtggtaggtgttgaggaatttcatgtagggcccgttgatgatgtagttctccctcctggtagtggacttgatgaagctgttctggagggcggcattctcccccgtgaagaccaccctgttcttgatcttgatgttcctggggcacagcatcagcaccttggacatgcgcacaggcagccgccggccgtacacccggccctgcagggccgcgtccaggtctggcaggtcgcaggtgggctccccatgcaccaccttggcctccttggccgtgaggacccccttgtcgatggccaggctcctaaagttggtgcacagcgtctggtagtgaccctttagccactctggggggctctggccaagcccggggttgtcattctcatagcacatacagatgggcagggagatgtcctgcaggatggtcagcagtgagcggtaaaacagctgggtgaagatggggcaggcgggctgcgcaaaggggttgcacgagtactgcatcacgtggtagcagctcttgaccaggtccttgtaggtgatgttgttcttggccatgctgttcataaactggaccacttcggcgtccaccgccgcatccacgtccttgaacatcttgacaaagtcacgcgggccatggggctccttctctagctttccctcagcgtctatgcccagccgagacagccgctccagcaggttctggttcagctgccagtaggtgtagcggggctcgtcgtccggccgctgcccgtcgtcctccttatcgatgaagttgagaaagttgcccaaaaagtccgtctcgttgtaggagcccgaggcccccgagatcacataggggtccctccgctgcgtggacatgacggggggaaagcggtccctcagcctaaagaagagcgtgttcaggcacacggccggggcccggccctcgcagagcgagcacatggggctggcggccgcccccgccacgtagctgcccgtctccggcaccggggtcagagagctcttctgtccctggcaaaactgcaggtagtaggcatagcgggcaagaaggttgggcgagaaggaggccgcatagaccaggtgctccacagcgtagtttcccggaccgttggttccggtcacgtctggcccaccccagcccgagaagcagggtcggcggcaggggtcccaggtcccctcctgcagggtccccaggccgtgggtcatgtagaaactgttaaagagactctccttgccctgaccggttgacttcgagacccccgagacgtagaggacggaattggtggcaaagatctgcgtggacacgtggggggccaggctggcattatatcggtgtaacgcagccacacgggcctctggaccctcacagtcggcaaacaggggccacgagtcgtagttgaggctggccggggtctcgtgcgaggcctccagcatggcgggcgcgtagctcaccgccagctcgcaggccgcgctgtccacaatcattaaggctcccgagtccgggtgactgatggttgaggctgggaactccttgaggggggccaccttggccaccttggcctggtcctgcaggctctgcttctccagcagctccaccagcttgcccacccgtcggacgcgcagcgcctgcgccagcccggtgtacagcgcctcgtgcatgcagcggctgaggtccgagttgtaaaactggcggagctggggcacgccctctgggaacacctccttgtcgtagagcgggaccctaacgctcgcagactgccccaccgctacctcctgttttaacgatggaatggccaccaggtttccgctgtagagtcgctccttgaaggcctcggttattgccaccgccccaaggtaggcagagggatctagcccttcggggaagaagtcccccggctcggagctttccctcggtagggcgctgtaggcgtcgtatccaaacacctccctggtctcgccacagagggcctcgagacccggcccctcaaagatggggggaaccatatgggcattgtggaacacgtagatgtccctgtgataggaggtagcgcgtaggagcccgcagttggggtcgggcctcctgtgcagagccttgacattgatgctgaagcccggctccacggtgatgccacaaaggagcggcaccgtcaggcacctgtggcccgcgtagccggtccccagtgtggccacctccctaagagggtaggtggccagggggtaaaagtagatgtagccgcacggacccggctggctctggctgcccagattatcctcgctagtctgtgcaccctgcatgatgcccaaggtatcgccccggcctcccagtcccacattaaatgttacactttactcatcacgcaacacccactgtttattcatttacaaagatttcaggaagtcagtcaggctggccagggcccacgtcacggggaactgacgtctcagcgatcttggcatgccgcccagcctcgcaaaccagagtctgcgatagagggccaggtagtgggcgattgcccccagcacgaaggcggcgctcttgtggtcatccaggtagtttcgcaccgcaaacaccactgtgtagcacagcaccaccctgagccgcgaccagtagtcgtagtggtcgttgtacactgcgcgcaggacgctgatgatgagccgtacgtgcgtgtctttgcccccgatgtcggctgtcctgcaggccagctccgcgtacagcttcctatccttcctcagggaggccttgatgagccggcagaggaccagggctggcaaaggcaggtctttctcatcccgggtgaacaccgcgtacatggccctgaacatgaggtagctggactcagccaccttgtcgtccggcggcgagggcgcgacccacgcctcgaccggggtcctcacaaacacagaatctgtagacttggctggcctcatggtctcgtcaggccagctcacgggcttcaggcttatatgataaaatgggcgtggcagaatagtataagacgcgaggcctgggtgaggagagtccagagcaatggccaggttcatcgctcagctcctcctgttggcctcctgtgtggccgccggccaggctgtcaccgctttcttgggtgagcgagtcaccctgacctcctactggaggagggtgagcctcggtccagagattgaggtcagctggtttaaactgggcccaggagaggagcaggtgcttattgggcgcatgcaccacgatgtcatctttatagagtggcctttcaggggcttctttgatatccacagaagtgccaacaccttctttttagtagtcaccgctgccaacatctcccatgacggcaactacctgtgccgcatgaaactgggcgagaccgaggtcaccaagcaggaacacctgagcgtggtgaagcctctaacgctgtctgtccactccgaaaggtctcagttcccagacttctctgtccttactgtgacatgcaccgtgaatgcatttccccatccccacgtccagtggctcatgcccgagggcgtggagcccgcaccaactgcggcaaatggcggtgttatgaaggaaaaggatgggagcctctctgttgctgttgacctgtcacttcccaagccctggcacctgccagtgacctgcgttgggaaaaatgacaaggaggaagcccacggggtttatgtttctggatacttgtcgcaataaacgcacttgcctatttcaccttgtcttagtgtggcatggggggggtggcattgcgggtggatagcctcgcgactcgtgggaaaatgggcggaagggcaccgtgggaaaatagttccaggtgacagcagcagtgtgtgaagattgtcacagctgctggtttggagaaaacgggggtgggcggtgatcagggagaacaattccccggggacacctgcacgagacccctgcgctctcaggaacttcgcccaggtctcgccaattggggtgatcctgtagcgccgcggtttcagcatcacaggttattttgcctgaagcttgctggggcgtaaatccctctcgccttgtttctcagagagcatttcaggccggttttgcagtcgctgctgcagctatggggtccctagaaatggtgccaatgggcgcgggtccccctagccccggcggggatccggatggggacgatggcggaaacaactcccaatatccatctgcttctggctcttctgggaacacccccaccccaccgaacgatgaggaacgtgaatctaatgaagagcccccaccgccttatgaggacccatattggggcaatggcgaccgtcactcggactatcaaccactaggaacccaagatcaaagtctgtacttgggattgcaacacgacgggaatgacgggctccctccccctccctactctccacgggatgactcatctcaacacatatacgaagaagcgggcagaggaaggtaagagtgccatctatctgtacttttatttattgcatcacaagtcacatcaataataagggcgccatctagcgggagatgttatccacaccatcccaattcacatctcagggacaacaggtcaaagttctttgttgacacccccagcgctggctccagggggtggcagcgttggatgcagtcctccgcatcggggcggacgcctcctcccaacgcgtttctgcggatcagtcgctggctggtgggcatcggagtcggtgggcggtcctccacggggacacgctccttcttggccttgttctttgaccttttggacattcttctgaaggaacggcggagagtagcgtagaatccagccagtggtctacccggtcgcatggtggcttcttagatgaggagcaggcataaaagtccaaacaggacacagagtaccaccaggagtagtcttagtctgctgacgtctgggtcctcggggcaggggtggctaggcctggtctccgtagaagagccgggcaggccgcaggcagaggactgctgctctagcaaagcacgctccaggacgtgtaccatctcgagagtgaggcacagctgttttcgtggacttttatacagtaaggacaaggaaagaaggccagaggaatgtggaaagatgagcgaggacaggtgtggaggttttgggctagctcttagtttctgggtgtgagagagggattaaagtgcttatgcgcaaagaatgtgtcaacaacaggtgttcctgcatctgctggcatgagttaggtgtggcttgggctgaatccaaatgtgtattggcacaagatggaaagcaaagttgctggagttactgggtgggagacagggatgtatgtggtcccccgctggtatgccagtaccctgtggaagtaaggggcctcatctgcccggtagttgtgttgtgcagaggtctgatgtgtgtaggaggggtgggttcaacgcaggggcgttggtggcggagtctggcaacgcccgggtcctcttgctacctgtgtggtgtgtgaagggctgggtaaaggtgtctgccaattctcgcatgtcctcctttccccttgttttgaaatagaatatgaatgtggcttttcagcctagacagacagtgtggctaagggagtgtgtgccagttaaggtgattagctaaggcattcccagtaaatggagggagagtcagtcaggcaagcctatgacatggtaatgcctagaagtaaagaaaggttagtcatagtagcttagctgaactgggccgtgggggtcgtcatcatctccaccggaaccagaagtacccaaaagcagcgtaggaaggtgtggatcaccgccgccaccgtctgtcatcgaaggcgggccccggtcacctcctttgttttcaacctcttccgtcaaatttggtgggcctccatcatttccagcagagtcgctagggttatgaggcagcgggtcatgtgggccattgtcagcagtgttgtcagggtcctgtgggccattgtcatcagtgttgtcagggtcctgtgggccattgtcatcagtgttgtcagggtcctgtgggccattgtcatcagtgttgtcagggtcctgtgggccattgtcaggaccacctccaggtgcgcctaggttttgagagcagagtgggggtccgtcgccggctccagtcacgagcaggtggtgtctgccctcgttggagttagagtcagattcatggccagaatcatcggtagcttgttgagggtgcgggagggagtcatcgtggtggtgttcatcactgtgtcgttgtccatggtaatacatccagatcaaaatcgccagaaacaggaggagccaaaggagatcaaccaatagagtccaccagttttgttgcagatagagagcaataatgagcaggatgaggtctaggaagaaggctaggaagaaggccaaaagctgccagatggtggcaccaagtcgccagagaatctccaataagtagatccagagacctaagactgcgttgaaaaaagagtgttagggttggaaaagtgggggtgtggtaaataattcccagggaatgttagatcttaccaagtaagcacccgaagatgaacagcacaattccaaggtacaatgcctgtccgtgcaaattccagagagcgatgagcaggagggtgactggggaaagaggagaaagtgcgttagagaaggaagagtaagggaaagggggtgtggggcaaagggtgtaatacttactcatcagtaggagtagacaaagggctccaagtggacagagaaggtctcttctgaagataaagatgatcaaaattataattataagtatgagagcaaaggaatagaggacaaggagggctcctccagtccagtcactcataacgatgtacagccaaaacagtagcgccaagaggaggagaaggagagcaaggcctagggaagaggagagggggggtcctcgagggggccgtcgcgggcccggtgggcccctctcaaggtcgtgttccatcctcagggcagtgtgtcaggagcaaggcagttgaggaaagaagggggcagagcagtgtgagaggcttatgtagggcggctacgtcagagtaacgcgtgtttcttgggatgtagggccggggggatttgcggggtctgccggaggcagtacgggtacagatttcccgaaagcggcggtgtgtgtgtgcatgtaagcgtaaaaaggggaagtagaaagcgtgtgttagtgttagaaaagcgggtccccggggggcaagctgtgggaatgcggtgggcaagtgcaacaggaaatggaaaggcagtgcggcaatcagaagggggagtgcgtagtgttgtgggaagcggcagtgtaatctgcacaaagaggcgtggggcgcgcaacgttgggaggtcgttggcggcaggcgggaggccgtgctttaggggggttcaggtgaggcaaggctgtggggtaaccgtaggggaggcgggtgaggcggctaagagggctaagggtcggcgggtgacgaagcagcagacggcggatatgggaatttcagaatgaggtggcggattcaggcgaaaagggtgtgggctgtgcgagtgtcatgaggcaggcgcggaaagtcgctgcggcttgctggggccatgggccgcgcattcctggaaaaagtggagggggcgtggcctgccccccgcggccccctagcccccccgcacagagcggcgcaacggcgggcgggcggcggggggtcggggtccgcgggctccgggggctgcgggcggtggatggcggctggcgttcaggggaacgggggggtcggggggcgcagcggccgcgcagccatgcgtgaccgcgaggaggggacagggtcgcagggggcgtgtctggtgggggcgggagcggggggcggcgcgggagcctgcacgccgttggagggtagaatgacaggggggcggggacagagaggcggtcgcgccccccgccgcggcagccaagcccccaaggggggcggggcgcgggcagcggagcgtgacgaagggccccagggctgaccccggcaaacgtgacccggggctccggggtgacccagccaagcgtgaccaaggggccgctgggtgacacagacaaccctgacaaaggccccccaggaaagacccccggggggcatcggggggtgttggtggggccatgggggtggggccatgggccgcgcattcctggaaaaagtggagggggcgtggcctgccccccgcggccccctagcccccccgcacagagcggcgcaacggcgggcgggcggcggggggtcggggtccgcgggctccgggggctgcgggcggtggatggcggctggcgttcaggggaacgggggggtcggggggcgcagcggccgcgcagccatgcgtgaccgcgaggaggggacagggtcgcagggggcgtgtctggtgggggcgggagcggggggcggcgcgggagcctgcacgccgttggagggtagaatgacaggggggcggggacagagaggcggtcgcgccccccgccgcggcagccaagcccccaaggggggcggggcgcgggcagcggagcgtgacgaagggccccagggctgaccccggcaaacgtgacccggggctccggggtgacccagccaagcgtgaccaaggggccgctgggtgacacagacaaccctgacaaaggccccccaggaaagacccccggggggcatcggggggtgttggtggggccatgggccgcgcattcctggaaaaagtggagggggcgtggcctgccccccgcggccccctagcccccccgcacagagcggcgcaacggcgggcgggcggcggggggtcggggtccgcgggctccgggggctgcgggcggtggatggcggctggcgttcaggggaacgggggggtcggggggcgcagcggccgcgcagccatgcgtgaccgcgaggaggggacagggtcgcagggggcgtgtctggtgggggcgggagcggggggcggcgcgggagcctgcacgccgttggagggtagaatgacaggggggcggggacagagaggcggtcgcgccccccgccgcggcagccaagcccccaaggggggcggggcgcgggcagcggagcgtgacgaagggccccagggctgaccccggcaaacgtgacccggggctccggggtgacccagccaagcgtgaccaaggggccgctgggtgacacagacaaccctgacaaaggccccccaggaaagacccccggggggcatcggggggtgttggtggggccatggggggtcggatttcgcccttattgccctgttt

SEQ ID NO: 3 - DNA, 2590 bp, Epstein-Barr-Virus (EBV)
tattaaaaacccagaagacctcaccttgccacccagatgtgtcatggctcacaaagtcacgagcgcaaacgagccaaaccccctgaccggaaaaagactgtccagctgccccctcacgaggagtggcgtaacagaggtggcacagatcgcgggcagaactccaaagatggaggactttgtgccctggaccgtggacaatctgaaaagccagttcgaggcagtcggccttttgatggcccactcctatcttccagccaacgcggaagaaggcatagcctacccaccactcgtccacacctacgagtccctctctccagccagcacctgccgagtttgtgatctgctcgacaccctggtcaatcactcagatgcccccgtggccttctttgaggactatgccctgctctgctactactgtctaaatgccccacgagcctggatctctagcctcatcacaggcatggactttttacacatcctgataaaatacttccccatggccggggggttggattccctcttcatgccctccaggattcttgccattgacatccagcttcacttttacatttgccggtgcttcctccctgtgtcctcttctgacatgattagaaatgccaacctcggctactacaaattggagtttctgaaatccatcctcaccggccagtccccggccaacttctgcttcaagtccatgtggcccagaaccacccccacttttcttaccctccctggacccagaacctgcaaagattcccaggatgtcccaggggacgtcggcaggggcctgtacaccgccctgtgctgccacctgcctaccagaaaccgagttcagcatccatttctcagggccgaaaagggaggactctctcctgaaattacaaccaaggccgactactgtggactactattaggtacgtggcaggggacggacctgctcggggggccaggccaccatgctatcggtttaaacgcggaatacagcggcgatgagctggcggagttggccctggccatcaccagaccggaggctggcgaccattcgcagggcccctgcctcctggcccccatgtttggactaaggcacaagaatgcctcacggaccatctgcccactctgcgagagcctcggggcccacccggacgccaaggacacccttgaccgcttcaagagcctgattcttgactcgttcggcaacaacatcaaaatcctagacaggatcgtgttcctcatcaagacccaaaacacgctgctggatgtgccatgccccaggctaagggcctggctgcagatgtgcaccccgcaagacttccacaagcacctgttctgcgaccccctgtgtgccatcaaccacagcatcacgaatccgagcgtgctgtttggtcagatttacccacccagcttccaggcctttaaggcagcgcttgcagccggtcagaatctggaacagggggtctgtgactcgttaattacgcttgtgtacatatttaaatccacacaagtggccagagtgggcaaaacaatcctcgtggatgtcactaaggaactggacgtggtcctgcgcatccacggccttgacctggtacagtcctatcaaacttcccaggtctacgtgtgaaaagtaaacccgatggccccggtcaccccagatgccgtgaatgcacgccaacagcgaccggcagatcccgcattgcgccgcctaatgcatccgcaccacagaaactacacggcctcaaaggcctcggcgcatagcgtgaagtcggtgtccaggtgtggaaaatctcgctcagagctgggaagaatggaaagggttggcagtgtggcccgatcaatatgttcccggcacaccagacatggtgtagacagatcccatttttcactacgggacttcttcaggggaatctctgccaactttgagctgggcaaagattttctgcgtgagatgaacacccccatacatgtctcagaggccgtgtttctcccactgtcactgtgcactctctcccccgggcgctgccttcgcctgtctcccttcggccacagcctgactctggggtctcactgcgagatctgcatcaataggtcccaggttcatgtgcctcaggagtttagctccacccagctctccttcttcaacaatgtccacaagataatacccaacaagaccttctatgtgtctctgctcagcagctctcccagtgcagtaaaggctggactttcccaacccagccttctctacgcttacctggtcaccggacacttttgtggcaccatctgccccatcttcagcacaaatggaaaagggcgcctaatcatgcatctcctgctccagggcacctcccttcacatcccagagacctgcttgaaactgttatgtgaaaacataggccccacctacgagctggccgtggacctagtaggggacgccttctgtataaaggtcagccccagagacacggtatatgagaaggctgtcaatgtcgacgaagatgccatctacgaggccatcaaggacctggaatgtggggatgagctgcgcctacagatcatcaactatacccagctcattttggaaaataaacagtag

SEQ ID NO: 4 - protein, 525 aa, Epstein-Barr-Virus (EBV)
MAHKVTSANEPNPLTGKRLSSCPLTRSGVTEVAQIAGRTPKMEDFVPWTVDNLKSQFEAVGLLMAHSYLPANAEEGIAYPPLVHTYESLSPASTCRVCDLLDTLVNHSDAPVAFFEDYALLCYYCLNAPRAWISSLITGMDFLHILIKYFPMAGGLDSLFMPSRILAIDIQLHFYICRCFLPVSSSDMIRNANLGYYKLEFLKSILTGQSPANFCFKSMWPRTTPTFLTLPGPRTCKDSQDVPGDVGRGLYTALCCHLPTRNRVQHPFLRAEKGGLSPEITTKADYCGLLLGTWQGTDLLGGPGHHAIGLNAEYSGDELAELALAITRPEAGDHSQGPCLLAPMFGLRHKNASRTICPLCESLGAHPDAKDTLDRFKSLILDSFGNNIKILDRIVFLIKTQNTLLDVPCPRLRAWLQMCTPQDFHKHLFCDPLCAINHSITNPSVLFGQIYPPSFQAFKAALAAGQNLEQGVCDSLITLVYIFKSTQVARVGKTILVDVTKELDVVLRIHGLDLVQSYQTSQVYV

SEQ ID NO: 5 - DNA, 1578 bp, Epstein-Barr-Virus (EBV)
atggctcacaaagtcacgagcgcaaacgagccaaaccccctgaccggaaaaagactgtccagctgccccctcacgaggagtggcgtaacagaggtggcacagatcgcgggcagaactccaaagatggaggactttgtgccctggaccgtggacaatctgaaaagccagttcgaggcagtcggccttttgatggcccactcctatcttccagccaacgcggaagaaggcatagcctacccaccactcgtccacacctacgagtccctctctccagccagcacctgccgagtttgtgatctgctcgacaccctggtcaatcactcagatgcccccgtggccttctttgaggactatgccctgctctgctactactgtctaaatgccccacgagcctggatctctagcctcatcacaggcatggactttttacacatcctgataaaatacttccccatggccggggggttggattccctcttcatgccctccaggattcttgccattgacatccagcttcacttttacatttgccggtgcttcctccctgtgtcctcttctgacatgattagaaatgccaacctcggctactacaaattggagtttctgaaatccatcctcaccggccagtccccggccaacttctgcttcaagtccatgtggcccagaaccacccccacttttcttaccctccctggacccagaacctgcaaagattcccaggatgtcccaggggacgtcggcaggggcctgtacaccgccctgtgctgccacctgcctaccagaaaccgagttcagcatccatttctcagggccgaaaagggaggactctctcctaaaattacaaccaaggccgactactgtggactactattaggtacgtggcaggggacggacctgctcggggggccaggccaccatgctatcggtttaaacgcggaatacagcggcgatgagctggcggagttggccctggccatcaccagaccggaggctggcgaccattcgcagggcccctgcctcctggcccccatgtttggactaaggcacaagaatgcctcacggaccatctgcccactctgcgagagcctcggggcccacccggacgccaaggacacccttgaccgcttcaagagcctgattcttgactcgttcggcaacaacatcaaaatcctagacaggatcgtgttcctcatcaagacccaaaacacgctgctggatgtgccatgccccaggctaagggcctggctgcagatgtgcaccccgcaagacttccacaagcacctgttctgcgaccccctgtgtgccatcaaccacagcatcacgaatccgagcgtgctgtttggtcagatttacccacccagcttccaggcctttaaggcagcgcttgcagccggtcagaatctggaacagggggtctgtgactcgttaattacgcttgtgtacatatttaaatccacacaagtggccagagtgggcaaaacaatcctcgtggatgtcactaaggaactggacgtggtcctgcgcatccacggccttgacctggtacagtcctatcaaacttcccaggtctacgtgtga

SEQ ID NO: 6 - protein, 525 aa, Epstein-Barr-Virus (EBV)
MAHKVTSANEPNPLTGKRLSSCPLTRSGVTEVAQIAGRTPKMEDFVPWTVDNLKSQFEAVGLLMAHSYLPANAEEGIAYPPLVHTYESLSPASTCRVCDLLDTLVNHSDAPVAFFEDYALLCYYCLNAPRAWISSLITGMDFLHILIKYFPMAGGLDSLFMPSRILAIDIQLHFYICRCFLPVSSSDMIRNANLGYYKLEFLKSILTGQSPANFCFKSMWPRTTPTFLTLPGPRTCKDSQDVPGDVGRGLYTALCCHLPTRNRVQHPFLRAEKGGLSPKITTKADYCGLLLGTWQGTDLLGGPGHHAIGLNAEYSGDELAELALAITRPEAGDHSQGPCLLAPMFGLRHKNASRTICPLCESLGAHPDAKDTLDRFKSLILDSFGNNIKILDRIVFLIKTQNTLLDVPCPRLRAWLQMCTPQDFHKHLFCDPLCAINHSITNPSVLFGQIYPPSFQAFKAALAAGQNLEQGVCDSLITLVYIFKSTQVARVGKTILVDVTKELDVVLRIHGLDLVQSYQTSQVYV

SEQ ID NO: 7 - DNA, 2915 bp, Epstein-Barr-Virus (EBV)
catatttatgtggcggctcttgaacccaaaggcgctatagacggttgggcagtaggctcggagtgtctgggagaggttctgtgcggccacggttgtggctcccgtgaccaggcagtccatcgtgtggtggaggcagctaacgctggtgctcttgccagcccccgccgttcccgtaattacataggctgaaaagggcaggaaggggggctccgagagctccgggtcaaactcgggggagaacgtctccatatccgggagttgttggacgcggcgcctagccagggtccctatcctcctgactatacgcctcacggaggcgtctgaggtcatgttcaacatgaacgtggacgagagcgcctctggcgccctcggctcctcggccattcctgttcaccccacgccggcctcggtccgactttttgagatcctgcagggaaagtacgcctacgtccagggacagaccatctacgccaacctccgcaaccccggagtcttctcgaggcaggtgtttacccatttgtttaaacgagccatctctcattgcacgtacgatgacgtgctacatgactggaacaagttcgaggcctgcatccagaagcgatggccgagcgatgactcgtgtgcgagccggtttcgtgagtccaccttcgagtcgtggtccacgaccatgaagctgaccgtgcgtgacctgctgaccaccaacatctaccgagtgctacacagccgctccgtgctctcctatgagcgttatgtggactggatctgcgccaccggcatggtgcccgccgttaagaagcccataacccaagagctccactccaagataaagagcctgagggacaggtgcgtctgtcgggaattggggcacgagaggaccatcaggagtatcgggacggaattatatgaggcaacgaaggaaataatagagtcgctcaactccacgttcatcccccagtttacggaggtgaccatcgagtaccttccgaggagcgacgagtatgtggcctactactgtggccgccgcatcaggctgcatgtgctcttccccccggccatctttgccggaacggtgaccttcgacagcccggtgcagcgcctctaccagaacattttcatgtgctaccgcacgctggagcatgccaagatctgccagctcctgaacacggcccctctcaaggccatcgtgggccacggggggcgagacatgtacaaggacatcctggcccatctggagcagaactcacagcgcaaggaccccaagaaggagctgctgaacctgctggtcaagctctcggagaacaagaccatcagcggggtcacggacgtggtggaggagttcataacggatgcctccaacaacctggtggaccgcaaccgtctatttggccagcccggggagacagctgcacagggcctaaagaaaaaggtctccaacacggtggtcaagtgtctgactgatcagataaacgagcaatttgaccagattaatggcctagagaaggagagggagctctatctaaagaagatccgctccatggagtctcagctgcaggcctccctgggtcccggcggcaacaacccagcggcgtcagcccccgccgcagttgcggcagaagccgcgtctgtagatatactgacgggcagcaccgcctccgcaatcgaaaagctgttcaactccccgtccgccagcctgggtgccagggtgtctggtcacaatgaaagcatcctaaacagtttcgtttctcaatacatccccccttcgcgggaaatgactaaggatctgactgaactttgggaaagcgagctgtttaacaccttcaagttaacacccgtggttgataatcaggggcagcgtctctacgtcagatactcgtcagacacgatctctatattattgggccccttcacctatctggtggcagagctttcaccggtggaactcgtgacagatgtctacgccaccctaggcatcgtggagatcatcgacgagctctaccggagcagtcgcctggccatctacatcgaggacctcggtcgaaaatactgccccgcgagcgcgaccgggggagatcatggcatccggcaagcaccatcagcccggggggacacggagcctgaccatgcaaaaagtaagcctgcgcgtgaccccccgcctggtgctggaagttaaccgccataacgccatctgcgtggccaccaacgtccctgagttctacaatgccaggggggaccttaacatccgagacctccgggcccacgtcaaggcccggatgatctcgtcccagttttgcggctacgtcctcgtgagtctgctggactccgaggaccaggtcgaccacctcaacatattcccccacgtgttctccgagaggatgatcctgtacaaacccaacaatgtgaaccttatggagatgtgcgccctgctctcgatgattgagaatgccaagagcccctccataggcctctgccgggaggtgctgggtcgcctgaccctcttgcactccaagtgcaacaatctggactctctgtttctgtacaatggggccaggacgctgctgtccaccctggtcaagtaccacgacctggaggagggggctgccacccccgggccgtggaatgagggcctgagtctctttaagctgcacaaggagctgaagcgcgccccatccgaagcccgggacctcatgcagagcctctttctgacctcggggaagatggggtgcctggccaggtcacccaaggattactgcgcggatctaaacaaggaggaagatgccaactcgggcttcacatttaacctgttttatcaagattctttattgaccaagcatttccagtgccagaccgtcctccagaccttgagacgcaagtgcctcgggagtgacacggtctcaaaaataattccctagaataaa

SEQ ID NO: 8 - protein, 613 aa, Epstein-Barr-Virus (EBV)
MFNMNVDESASGALGSSAIPVHPTPASVRLFEILQGKYAYVQGQTIYANLRNPGVFSRQVFTHLFKRAISHCTYDDVLHDWNKFEACIQKRWPSDDSCASRFRESTFESWSTTMKLTVRDLLTTNIYRVLHSRSVLSYERYVDWICATGMVPAVKKPITQELHSKIKSLRDRCVCRELGHERTIRSIGTELYEATKEIIESLNSTFIPQFTEVTIEYLPRSDEYVAYYCGRRIRLHVLFPPAIFAGTVTFDSPVQRLYQNIFMCYRTLEHAKICQLLNTAPLKAIVGHGGRDMYKDILAHLEQNSQRKDPKKELLNLLVKLSENKTISGVTDVVEEFITDASNNLVDRNRLFGQPGETAAQGLKKKVSNTVVKCLTDQINEQFDQINGLEKERELYLKKIRSMESQLQASLGPGGNNPAASAPAAVAAEAASVDILTGSTASAIEKLFNSPSASLGARVSGHNESILNSFVSQYIPPSREMTKDLTELWESELFNTFKLTPVVDNQGQRLYVRYSSDTISILLGPFTYLVAELSPVELVTDVYATLGIVEIIDELYRSSRLAIYIEDLGRKYCPASATGGDHGIRQAPSARGDTEPDHAKSKPARDPPPGAGS

SEQ ID NO: 9 - DNA, 1842 bp, Epstein-Barr-Virus (EBV)
atgttcaacatgaacgtggacgagagcgcctctggcgctctcggctcctcggccattcctgtgcaccccacgccggcctcggtccgactttttgagatcctgcagggaaagtacgcctacgtccagggacagaccatctacgccaacctccgtaaccccggagtcttctcgaggcaggtgtttacccatttgtttaaacgagccatctctcattgcacgtacgatgacgtgctacatgactggaacaagttcgaggcctgcatccagaagcgatggccgagcgatgactcgtgtgcgagccggtttcgtgagtccaccttcgagtcgtggtccacgaccatgaagctgaccgtgcgtgacctgctgaccaccaacatctaccgagtgctacacagccgctccgtgctctcctatgagcgttatgtggactggatctgcgccaccggcatggtgcccgccgttaagaagcccataacccaagagctccactccaagataaagagcctgagggacaggtgcgtctgtcgggaattggggcatgagaggaccatcaggagtatcgggacggaattatatgaggcaacgagggaaataatagagtcgctcaactccacgttcatcccccagtttacggaggtgaccatcgagtaccttccggggagcgacgagtatgtggcctactactgtggccgccgcatcaggctgcatgtgctcttccccccggccatctttgccggaacggtgaccttcgacagcccggtgcagcgcctataccagaacattttcatgtgctaccgcacgctggagcatgccaagatctgccagctcctgaacacggcccctctcaaggccatcgtgggccacggggggcgagacatgtacaaggacatcctggcccatctggagcagaactcacagcgcaaggaccccaagaaggagctgctgaacctgctggtcaagctctcggagaacaagaccatcagcggggtcacggacgtggtggaggagttcataacggatgcctccaacaacctggtggaccgcaaccgtctatttggccagcccggggagacggctgcgcagggcctaaagaaaaaggtctccaacacggtggtcaagtgtctgactgatcagataaacgagcaatttgaccagattaatggcctagagaaggagagggagctctatctaaagaagatccgctccatggagtctcagctgcaggcctccctgggtcccggcggcaacaacccagcggcgtcagcccccgccgcagttgcggcagaagccgcgtctgtagatatactgacgggcagcaccgcctccgcaatcgaaaagctgttcaactccccgtccgccagcctgggtgccagggtgtctggtcacaatgaaagcatcctaaacagtttcgtttctcaatacatccccccttcgcgggaaatgactaaggatctgactgaactttgggaaagcgagctgtttaacaccttcaagttaacacccgtggttgataatcaggggcagcgtctctacgtcagatactcgtcagacacgatctctatattattgggccccttcacctatctggtggcagagctttcaccggtggaactcgtgacagatgtctacgccaccctaggcatcgtggagatcatcgacgagctctaccggagcagtcgcctggccatctacatcgaggacctcggtcgaaaatactgccccgcgagcgcgaccgggggagatcatggcatccggcaagcaccatcagcccggggggacgcggagcctgaccatgcaaaaagtaagcctgcgcgtgaccccccgcctggtgctggaagttaa

SEQ ID NO: 10 - protein, 613 aa, Epstein-Barr-Virus (EBV)
MFNMNVDESASGALGSSAIPVHPTPASVRLFEILQGKYAYVQGQTIYANLRNPGVFSRQVFTHLFKRAISHCTYDDVLHDWNKFEACIQKRWPSDDSCASRFRESTFESWSTTMKLTVRDLLTTNIYRVLHSRSVLSYERYVDWICATGMVPAVKKPITQELHSKIKSLRDRCVCRELGHERTIRSIGTELYEATREIIESLNSTFIPQFTEVTIEYLPGSDEYVAYYCGRRIRLHVLFPPAIFAGTVTFDSPVQRLYQNIFMCYRTLEHAKICQLLNTAPLKAIVGHGGRDMYKDILAHLEQNSQRKDPKKELLNLLVKLSENKTISGVTDVVEEFITDASNNLVDRNRLFGQPGETAAQGLKKKVSNTVVKCLTDQINEQFDQINGLEKERELYLKKIRSMESQLQASLGPGGNNPAASAPAAVAAEAASVDILTGSTASAIEKLFNSPSASLGARVSGHNESILNSFVSQYIPPSREMTKDLTELWESELFNTFKLTPVVDNQGQRLYVRYSSDTISILLGPFTYLVAELSPVELVTDVYATLGIVEIIDELYRSSRLAIYIEDLGRKYCPASATGGDHGIRQAPSARGDAEPDHAKSKPARDPPPGAGS

SEQ ID NO: 11 - DNA, 5415 bp, Epstein-Barr-Virus (EBV)
atgctgtatgcctcgcagcgcggccgtctgaccgagaacctaagaaacgcccttcagcaggacagcaccacgcaaggctgcctgggtgccgagaccccgagtattatgtacacaggggccaagtcagacaggtgggctcaccctctggtgggcacaattcacgccagtaatttatattgcccaatgcttcgagcatactgccgccactatggccccaggcccgtgtttgtagcttctgatgaatcattacccatgttcggtgcgagccctgcccttcacaccccagtccaggtccagatgtgcctactaccagagctacgcgacacgttacagcgcctgctgccaccacccaatcttgaagactccgaggccttgacggaattcaagaccagcgtgtcctctgcccgtgccatccttgaggaccccaactttttggagatgagagagtttgtcaccagcctggccagcttcctgagtggtcagtacaagcacaagcccgcccgcctagaagcattccagaaacaagtagtgttacattctttttattttctgatctcaatcaaatctttagagattacagacaccatgtttgacatctttcaaagtgctttcggattggaagaaatgacgctggagaagctgcacatttttaagcaaaaagccagcgtgtttcttatccccaggcgccacggcaagacctggatagtcgtggccatcatcagcctcatcctctcgaatctctccaacgtgcaaataggctacgtggctcaccagaaacatgtcgcgtccgccgttttcactgaaattattgacaccttgaccaagagcttcgactccaagcgtgtagaggtcaacaaggagaccagcaccatcacgtttaggcacagtgggaaaatctccagcaccgtaatgtgtgccacctgcttcaataagaatgtaagacctgacgtttcagtacttggcaattgtagagcatagcccggctgtaaaggtcagaaaatcgcagcagggtccaaggttgtgctgtacatgggacctctttcccattagcaagaaccccctgcaggacacgtgacatgtccgggtgcattttgggtgggttaaatctcagtcccaccacaaagggggcatcctccggtttgaacatcagacccaacaaagcccgatgcccagttatgggtacgtagtcgttgttcagggccgtgcatggcagcagacaaggacaggtgccagatgtgcctgggctatcgtcctccgtccagccacgcaggatgttcacgtgggccccggcaccatagcatgtcacacattccccgttatcacatctggttagcaggttgataaaatgggtcagtgatggaaaggttggcatattggggcagcacatcagcatgtccatgttaacgaaaaacatgtacagggccccttctgcataccaggcaccaccccgtcccagtgggatgatctccgagggtgtgatatcttgcagttcttctactgttttaacggcggttgaggtggtaaagacgtgggccgtggtcagatctgtgcaggtgactacagggttacccctaatctccacaggcaccgcctcacccactgcatctgagaataccccaaagtacatgagagtcaggctgtgtggcccctggactgccttagtgaagagaacctcgggcctggccacggtggctagggttccattgatgtagacggtcacataggtgggcttcttcttgggcttcagcacaatgagggtaacattcatgtaggttttaggaggtccggctatctgaggcacgtacacagctgacacggcggttgtggccgtatagactttcatctggggcgtagaggcatcgctcagcacccagaggcactccttgttgaggaacttgcgaagctgttcccggctactgttcgcggcggatgccatgacgtgccagaatatatcccctctcctcgggggtgagtgccaattggcctttaataacaaagcccccaggcagcaccaaaaatgcctgcccgtccgatgtggtggccaggtggacgcagtgcccgtcagttccaagggctactagctgggaagcagccccaaccagcccacccgggggcctggagtcgatcaccttaccccaggccgaggccccttcctcatacagcgggtggctatctatccataggcaggcatccggcgtctttggtgcattggagatagtagctttcacccaacaactttcccaactaacccgtgtctggacagtgaagaacgcttccctgatcaggtctgaatttttatagatacgggagtaggaggtgggaataacaactgggatttcttgttgtgctgtccaggcctgcatggccagtttttccctgaagctagcagaaattctgagggccactgaaatgaggaagcgaaactccctctctggagctcccaaaattgaaacctcagcaagatctgttgctggggaggcatgggtgacagctgtcatcctgtgcagtctgccctgggcactcagctctggatatgtgacaacatagagagcgtgggggctaaaaatatgagcaattcccctgaccagggccctggactcacgaatggcccgacgggtcttagagaaagaaacaggcaccctcgagagtgcccccgacccgacccccacagtgccgccagtccctgctcggcctccgccgccttccccaccggcgctgccccggatgttgctggggttctcgagggctgggtggtgcttggacacagaggtctcagcagccgccttggtctcggccccggccctaagtctgagccccaggcaaagggccggactcccagcgtggcccaacctctgctcccctctattctcctcttgcgttatctccaatagaatttgcttgaggtcatacgttttagggtgctcgacctgggccgcggccaccggcatatgctctatacccgcccctccggggggcccaggatctataggtatgggctgcatagccgcagcagactcctggaccccagaggcctctctgataagatgcccgtcggtcagagcccttttggccccctcaaagagagacaggtaataaatctgtagctccccaaccagccctccttcatcgtaaaatcgaagggcggccacgtggaaggggttgtagagctctggaaggccctcatcgcagtacactggcacactggtaaacgtgccccgatggctaggccgtccgggcagcatgccccgagcagcaaacacgcggcagaccctcgtgagacccgtccggtcactgaagagagtctggcaccaggccccctcgcagtttggcacgcgattggggcaaagctctgccataaccgtgtcgggaacaaataggtgcacgaggaggggggtcccgaggccactcaacacttggttgtcaatgtggacatccatagctctctcatgcgtttggctacagcatcatagcgcttgtttctggtggatttaaataacagggccccgtagacagtcttttgtgagtaaatagagatgatgacatggatgtagagactgaggaccacatccaccaccttctcggaggaggcccccctaaacagcatcaggcagcaagggaacacaaaggaaaccagggccgggatgtgaggcctcagcgccccctcctgatcaaagagggcctcgctgaccccggagatgacattctcattcagaaagtagtgatagaggtgattgaccacagtcttaaccaggccctggacttgttcaggctcccacttgtcccgctggtcctgtgtgtcttgtcggatctcggtccagggcctcagcgccggctggaaatgcggccccatgtagttgcctgtaagggcgcacaccactccctcatgggtctcaatcagggtgcactcgctggatccatcacatacgtggtactcgccacagccccagcaggcaaacacggaggccatgctctcaggtaacgggagatggaactccagcttactatacgagcacaggtggcgaggattgggctcatccgtgcccccctccccccgcgggaggctcaatcggccttggtctgacattccaccccggccaggtccaggagggtgcaaatattctccaggcgctgcacctcagagacctcctgctcaaagagacctcccaccgccacgtagacgcgggccaccgtccggggaaggtcagtggggtcccagctcagcaattctccaaattctctctccccaatagtgcctcgcttcttatcctgtctttcagagcatccgggggcagacatttcacctcttgtttgtggacgaggctaactttatcaagaaggaggccctgccggcgatcctgggctttatgcttcagaaggatgccaagattatcttcatctcgtctgtgaactcggctgaccaggccaccagctttctttataagctgaaggatgctcaggagcggctgctgaacgtggtaagttatgtgtgtcaggagcatcggcaagattttgacatgcaggacagcatggtctcatgcccctgctttcgcctgcacatcccgtcctacatcaccatggacagcaacatccgagcaaccaccaacctctttctggacggggcctttagcaccgagctgatgggtgacacctcctcgctgagccagggtagcctgagccgcactgtgcgtgacgatgccatcaaccagctggagctctgccgggttgacaccctcaacccccgagtagccggacgcctagcctcctccctctacgtgtacgttgatccggcctataccaacaacacatccgcatcaggcaccggaatcgccgccgtgactcacgacagggcggaccctaacagggtcatcgtcctgggcctggaacacttcttcctcaaggacctaacaggggacgctgccctccagatcgccacctgcgtcgtggccctcgtctcctcgatcgtcaccctgcacccccacttggaggaggtgaaggtagccgtggagggcaacagcagtcaggactctgcggtggccattgcctcaatcattggggaatcctgccccctcccctgcgccttcgtgcacaccaaggacaagacgtccagcctgcagtggcccatgtacctcctgactaatgagaagtccaaggcctttgagaggctcatctacgcagtgaacacggccagcctttctgccagtcaggtcaccgtctccaacaccatccagctctccttcgatccggtcctctatctcatctcccagatcagggccatcaagcccatccctctccgcgacggtacctacacctacaccggcaagcagcgcaacctctctgacgacgtgctggttgcgctagtcatggctcattttctcgcaacaacacagaagcacacgttcaagaaagttcattaaa

SEQ ID NO: 12 - protein, 690 aa, Epstein-Barr-Virus (EBV)
MLYASQRGRLTENLRNALQQDSTTQGCLGAETPSIMYTGAKSDRWAHPLVGTIHASNLYCPMLRAYCRHYGPRPVFVASDESLPMFGASPALHTPVQVQMCLLPELRDTLQRLLPPPNLEDSEALTEFKTSVSSARAILEDPNFLEMREFVTSLASFLSGQYKHKPARLEAFQKQVVLHSFYFLISIKSLEITDTMFDIFQSAFGLEEMTLEKLHIFKQKASVFLIPRRHGKTWIVVAIISLILSNLSNVQIGYVAHQKHVASAVFTEIIDTLTKSFDSKRVEVNKETSTITFRHSGKISSTVMCATCFNKNSIRGQTFHLLFVDEANFIKKEALPAILGFMLQKDAKIIFISSVNSADQATSFLYKLKDAQERLLNVVSYVCQEHRQDFDMQDSMVSCPCFRLHIPSYITMDSNIRATTNLFLDGAFSTELMGDTSSLSQGSLSRTVRDDAINQLELCRVDTLNPRVAGRLASSLYVYVDPAYTNNTSASGTGIAAVTHDRADPNRVIVLGLEHFFLKDLTGDAALQIATCVVALVSSIVTLHPHLEEVKVAVEGNSSQDSAVAIASIIGESCPLPCAFVHTKDKTSSLQWPMYLLTNEKSKAFERLIYAVNTASLSASQVTVSNTIQLSFDPVLYLISQIRAIKPIPLRDGTYTYTGKQRNLSDDVLVALVMAHFLATTQKHTFKKVH

SEQ ID NO: 13 - DNA, 5411 bp, Epstein-Barr-Virus (EBV)
atgctgtatgcctcgcagcgcggccgtctgaccgagaacctaagaaacgccctgcagcaggatagcaccacgcaaggctgcctgggtgccgagaccccgagtattatgtacacgggggccaagtcagacaggtgggctcaccctctggtgggcacaattcacgccagtaatttatattgcccaatgcttcgagcatactgccgccactatggccccaggcccgtgtttgtagcttctgatgaatcattacccatgttcggtgcgagccccgcccttcacaccccagtccaggtccagatgtgcctactaccagagctacgcgacacgttacagcgcctgctgcccccacccaatcttgaagactccgaggccttgacggaattcaagaccagcgtgtcctctgcccgtgccatccttgaggaccccaactttttggagatgagagagtttgtcaccagcctggccagcttcctgagtggtcagtacaagcacaagcccgcccgcctagaagcattccagaaacaagtagtgttacattctttttattttctgatctcaatcaaatctttagagattacagacaccatgtttgacatctttcaaagtgctttcgggttggaagaaatgacgctggagaagctgcacatttttaagcaaaaagccagcgtgtttcttatccccaggcgccacggcaagacctggatagtcgtggccatcatcagcctcatcctctcgaatctctccaacgtgcaaataggctacgtggctcaccagaaacatgtcgcgtccgccgttttcactgaaattattgacaccttgaccaagagcttcgactccaagcgtgtagaggtcaacaaggagaccagcaccatcacgtttaggcacagtgggaaaatctccagcaccgtaatgtgtgccacctgcttcaataagaatgtaagacctgacgtttcagtacttggcaattgtagagcatagcccggctgtaaaggtcagaaaatcgcagcagggtccaaggttgtgctgtacatgggacctctttcccattagcaagaaccccctgcaggacgcgtgacatgtccgggtgcattttgggtgggttaaatctcagtcccaccacaaagggggcatcctccggtttgaacatcagacccaacaaagcccgatgcccagttatgggtacgtagtcgttgttcagggccgtgcatggtagcagacaaggacaggtgccagatgtgcctgggctatcgtcctccgtccagccacgcaggatgttcacgtgggccccggcaccatagcatgtcacacattccccgttatcacatctggttagcaggttgataaaatgggtcagtgatggaaaggttggcatattggggcagcacatcagcatgtccatgttaacgaaaaacatgtacagggccccttctgcataccaggcaccaccccgtcccagtgggatgatctccgagggtgtgatatcttgcagttcttctactgttttaacggcggttgaggtggtaaagacgtgggccgtggtcagatctgtgcaggtgactacagggtttcccctaatctccacaggcaccgcctcacccacggcatctgagaataccccaaagtacatgagagtcaggctgtgtggcccctggactgccttagtgaagagaacctcgggcctggccacggtggctagggttccattgatgtagacggtcacataggtgggcttcttcttgggcttcagcacaatgagggtaacattcatgtaggttttaggaggtccggctatctgaggcacgtacacagctgacacggcggttgtggccgtatagactttcatctggggcgtagaggcatcgctcagcacccagaggcactccttgttgaggaacttgcgaagctgttcccggctactgttcgcggcggatgccatgacgtgccagaatatatcccctctcctcgggggtgagtgccaattggcctttaataacaaagcccccaggcagcaccaaaaatgcctgcccgtccgatgtggtggccaggtggacgcagtgcccgtcagttccaagggctactagctgggaagcagccccaaccagcccaccggggggcctggagtcgatcaccttaccccaggccgaggccccttcctcatacagcgggtggctatctatccataggcaggcatccggcgtctttggtgcattggagatagctttcacccaacaactttcccaactaacccgtgtctggacagtgaagaacgcttccctgatcaggtctgaatttttatagatacgggagtaggaggtgggaataacaactgggatttcttgttgtgctgtccaggcctgcatggccagtttttccctgaagctagcagaaattctgagggccactgaaatgaggaagcgaaactccctctctggagctcccaaaattgaaacctcagcaagatctgttgctggggaggcatgggtgacagctgtcatcctgtgcagtctgccctgggcactcagctctggatatgtgacaacatagagagcgtgggggctaaaaatatgagcaattcccctgaccagggccctggactcacgaatggcccgacgggtcttagagaaagaaacaggcaccctcgagagtgcccccgacccgacccccacagtgccgccagtccctgctcggcctccgccgccttccccaccggcgctgccccggatgttgctggggttctcgagggctgggtggtgcttggacacagaggtctcagcagccgccttggtctcggccccggccctaagtctgagccccaggcaaagggccggactcccagcgtggcccaacctctgctcccctctattctcctcttgcgttatctccaatagaatttgcttgaggtcatacgttttagggtgctcgacctgggccgcggccatcggcatatgctctatacccgcccctccggggggcccaggatctataggtatgggctgcatagccgcagcagactcctggaccccagaggcctctctgatcagatgcccgtcggtcagagcccttttggccccctcaaagagagacaggtaataaatctgtagctccccaaccagccctccttcatcgtaaaatcgaagggcggccacgtggaaggggttgtagagctctggaaggccctcctcgcagtacactggcacactggtaaacgtgccccgatggctaggccgtccgggcagcatgccccgagcagcaaacacgcggcagaccctcgtgagacccgtccggtcactgaagagagtctggcaccaggccccctcgcagtttggcacgcgattggggcaaagctctgccataaccgtgtcgggaacaaataggtgcacgaggaggggggtcccgaggccactcaacacttggttgtcaatgtggacatccatagctctctcatgcgtttggctacagcatcatagcgcttgtttctggtggatttaaataacagggccccgtagacagtcttttgtgagtaaatagagatgatgacatggatgtagagactgaggaccacatccaccaccttctcggaggaggcccccctaaacagcatcaggcagcaagggaacacaaaggaaaccagggccgggatgtgaggcctcagcgccccctcctgatcaaagagggcctcgctgaccccggagatgacattctcattcagaaagtagtgatagaggtgattgaccacagtcttaaccaggccctggacttgttcaggctcccacttgtcccgctggtcctgtgtgtcttgtcggatctcggtccagggcctcagcgccggctggaaatgcggccccatgtagttgcctgtaagggcgcacaccactccctcatgggtctcaatcagggtgcactcgctggatccatcacatacgtggtactcgccacagccccagcaggcaaacacggaggccatgctctcaggtaacgggagatggaactccagcttactatacgagcacaggtggcgaggattgggctcatccgtgcccccctccccccgcgggaggctcaatcggccttggtctgacattccaccccggccaggtccaggagggtgcaaatattctccaggcgctgcacctcagagacctcctgctcaaagaggcctcccaccgccacgtagacgcgggccaccgtccggggaaggtcagtggggtcccagctcagcaattgtccaaattctgtctccccaatagtgactcgcttcttatcctgtctttcagagcatccgggggcagacatttcacctcttgtttgtggacgaggctaactttatcaagaaggaggccctgccggcgatcctgggctttatgcttcagaaggatgccaagattatcttcatctcgtctgtgaactcggctgaccaggccaccagctttctttataagctgaaggatgctcaggagcggctgctgaacgtggtaagttatgtgtgtcaggagcatcggcaagattttgacatgcaggacagcatggtctcatgcccctgctttcgcctgcacatcccgtcctacatcaccatggacagtaacatccgagcaaccaccaacctctttctggacggggcctttagcaccgagctgatgggtgacacctcctcgctgagccagggtagcctgagccgcactgtgcgtgacgatgccatcaaccagctggagctctgccgggttgacaccctcaacccccgagtagccggacgcctagcctcctccctctacgtgtacgttgatccggcctataccaacaacacatccgcatcaggcaccggaatcgccgccgtgactcacgacagggcggaccctaacagggtcatcgtcctgggcctggaacacttcttcctcaaggacctaacaggggacgctgccctccagatcgccacctgcgtcgtggccctcgtctcctcgatcgtcaccctgcacccccacttggaggaggtgaaggtagccgtggagggcaacagcagtcaggactctgcggtggccattgcctcaatcattggggaatcctgccccctcccctgcgccttcgtgcacaccaaggacaagacgtccagcctgcagtggcccatgtacctcctgactaatgagaagtcaaaggcctttgagaggctcatctacgcagtgaacacggccagcctttctgccagtcaggtcaccgtctccaacaccatccagctctccttcgatccggtcctctatctcatctcccagatcagggccatcaagcccatccctctccgcgacggtacctacacctacaccggcaagcagcgcaacctctctgacgacgtgctggttgcgctagtcatggctcattttctcgcaacaacacagaagcacacgttcaagaaagttcattaa

SEQ ID NO: 14 - protein, 690 aa, Epstein-Barr-Virus (EBV); identical to SEQ ID NO: 12

SEQ ID NO: 15 - DNA, 4665 bp, Epstein-Barr-Virus (EBV)
atgtcggggctgctggcggcggcgtacagccaggtgtacgccctggcggttgagctgagcgtgtgcacccggctggacccccggagtctggacgtggctgcggtggtgcgcaacgccggcctgctggccgagctggaggccatcctccttccccgtttgagacggcagaatgaccgtgcatgcagcgccctgtccctggagctggtgcacctgctagagaactcgagagaggcctctgccgcgctgctcgcccctggtagaaagggtacccgggtcccgcctctccgtaccccctcagtcgcgtactctgtggagttttacggggggcataaagtcgatgtaagtttgtgcctaataaatgacatagagattttaatgaagagaatcaatagcgtgttttattgcatgtctcacaccatggggctggagagcctggaacgggccctggatctgctgggccgctttcggggcgtaagtcccatcccagacccgcgcctctacatcacctctgtgccctgctggcgctgtgtgggcgagctgatggttctgcccaaccacggcaacccttccacggcagaggggacccacgtctcctgtaaccacctggcggtgccggtgaatccggagccggtctcgggactgtttgagaatgaagtccgccaggcggggctcgggcacctgttggaggctgaggagaaggcgaggccgggcggcccagaggagggcgcggtcccgggcccggggcggccggaggcagagggggcgaccagagcgctggacacctacaacgtcttctcgacagtgcccccggaggtggcggagctctcggagctcctctattggaactctggcggccatgctatcggtgcaacggggcagggggagggtggcggccattcccgcctctctgccctgtttgcccgggagcgtcgcctggccctggtgcggggggcctgcgaggaggcgctggcgggggcaaggctgactcacctgtttgacgccgtggctcccggggccacggagcggctcttctgcggcggggtctacagctcctcgggcgacgcggtggaggcgctgaaggcggactgcgccgccgccttcacggcgcacccccagtaccgggccatcctgcaaaagaggaacgagctgtacacgcggctcaaccgagccatgcagcggttgggccgaggcgaggaggaggcgtcccgggagagcccggaggtgccccggccggctggggcacgagagcccggcccgtccggcgccctctcggacgcgctcaagcgcaaggagcagtacctgcgccaggtggccaccgagggtctggccaagctgcagtcctgcctggcgcaacagagcgagaccctgaccgagaccctgtgcctgcgcgtctggggggacgtggtctactgggagctggcccgcatgcgcaaccacttcctctacagacgggccttcgtctcgggtccctgggaggacaggcgcgccggcgagggtgccgcctttgagaattccaagtacatcaaaacacacctgtttacccagaccctgagctcggagcacctgcacgcgctgacgcacagcctgtacaccttcatcacggggcccctggcggaggagagcgggctctttcccccacccagcaacgtggccctggctcgctgctgtgacgccgcaggtacgctgccccaccagaaggcattcctgacttccctgatatggccaggcatcgagccgagcgactggatagagacctccttcaacagcttctacagcgtacccgggggctcactggcatctagccagcaaattctgtgccgggcgctgcgcgaggccgtcctaaccgtgtccctctacaacaagacctgggggcggtccttgatcctgcgccgggcggacgcggtcagccccggccaggccctgcccccggatgggctttacctcacgtacgactctgaccgccccctaattcttctgtataagggcagggggtgggtatttaaggatctatatgcccttctctacctgcacctccaaatgagagatgactcggcgtagggtgctaagcgtggtcgtgctgctagccgccctggcgtgccgtctcggtgcgcagaccccagagcagcccgcaccccccgccaccacggtgcagcctaccgccacgcgtcagcaaaccagctttcctttccgagtctgcgagctctccagccacggcgacctgttccgcttctcctcggacatccagtgtccctcgtttggcacgcgggagaatcacacggagggcctgttgatggtgtttaaagacaacattattccctactcgtttaaggtccgctcctacaccaagatagtgaccaacattctcatctacaatggctggtacgcggactccgtgaccaaccggcacgaggagaagttctccgttgacagctacgaaactgaccagatggataccatctaccagtgctacaacgcggtcaagatgacaaaagatgggctgacgcgcgtgtatgtagaccgcgacggagttaacatcaccgtcaacctaaagcccaccgggggcctggccaacggggtgcgccgctacgccagccagacggagctctatgacgcccccgggtggttgatatggacttacagaacaagaactaccgtcaactgcctgataactgacatgatggccaagtccaacagccccttcgacttctttgtgaccaccaccgggcagactgtggaaatgtcccctttctatgacgggaaaaataaggaaaccttccatgagcgggcagactccttccacgtgagaactaactacaagatagtggactacgacaaccgagggacgaacccgcaaggcgaacgccgagccttcctggacaagggcacttacacgctatcttggaagctcgagaacaggacagcctactgcccgcttcaacactggcaaacctttgactcgaccatcgccacagaaacagggaagtcaatacattttgtgactgacgagggcacctctagcttcgtgaccaacacaaccgtgggcatagagctcccggacgccttcaagtgcatcgaagagcaggtgaacaagaccatgcatgagaagtacgaggccgtccaggatcgttacacgaagggccaggaagccattacatattttataacgagcggaggattgttattagcttggctacctctgaccccgcgctcgttggccaccgtcaagaacctgacggagcttaccactccgacttcctcaccccccagcagtccatcgcccccagccccatccgcggcccgcgggagcacccccgccgccgttctgaggcgtcggaggcgggatgcggggaacgccaccacaccggtgccccccacggcccccgggaagtccctgggcaccctcaacaatcccgccaccgtccagatccaatttgcctacgactccctgcgccgccagatcaaccgcatgctgggagaccttgcgcgggcctggtgcctggagcagaagaggcagaacatggtgctgagagaactaaccaagattaatccaaccaccgtcatgtccagcatctacggtaaggcggtggcggccaagcgcctgggggatgtcatctcagtctcccagtgcgtgcccgttaaccaggccaccgtcaccctgcgcaagagcatgagggtccctggctccgagaccatgtgctactcgcgccccctggtgtccttcagctttatcaacgacaccaagacctacgagggacagctgggcaccgacaacgagatcttcctcacaaaaaagatgacggaggtgtgccaggcgaccagccagtactacttccagtccggcaacgagatccacgtctacaacgactaccaccactttaaaaccatcgagctggacggcattgccaccctgcagaccttcatctcactaaacacctccctcatcgagaacattgactttgcctccctggagctgtactcacgggacgaacagcgtgcctccaacgtctttgacctggagggcatcttccgggagtacaacttccaggcgcaaaacatcgccggcctgcggaaggatttggacaatgcagtgtcaaacggaagaaatcaattcgtggacggcctgggggaacttatggacagtctgggtagcgtgggtcagtccatcaccaacctagtcagcacggtggggggtttgtttagcagcctggtctctggtttcatctccttcttcaaaaaccccttcggcggcatgctcattctggtcctggtggcgggggtggtgatcctggttatttccctcacgaggcgcacgcgccagatgtcgcagcagccggtgcagatgctctaccccgggatcgacgagctcgctcagcaacatgcctctggtgagggtccaggcattaatcccattagtaagacagaattacaagccatcatgttagcgctgcatgagcaaaaccaggagcaaaagagagcagctcagagggcggccggaccctcagtggccagcagagcattgcaggcagccagggaccgttttccaggcctacgcagaagacgctatcacgatccagagaccgccgccgcactgcttggggaggcagagactgagttttaaccatgtctgggggactcttctataaccctttcctaagacctaataaa

SEQ ID NO: 16 - protein, 685 aa, Epstein-Barr-Virus (EBV)
MSGLLAAAYSQVYALAVELSVCTRLDPRSLDVAAVVRNAGLLAELEAILLPRLRRQNDRACSALSLELVHLLENSREASAALLAPGRKGTRVPPLRTPSVAYSVEFYGGHKVDVSLCLINDIEILMKRINSVFYCMSHTMGLESLERALDLLGRFRGVSPIPDPRLYITSVPCWRCVGELMVLPNHGNPSTAEGTHVSCNHLAVPVNPEPVSGLFENEVRQAGLGHLLEAEEKARPGGPEEGAVPGPGRPEAEGATRALDTYNVFSTVPPEVAELSELLYWNSGGHAIGATGQGEGGGHSRLSALFARERRLALVRGACEEALAGARLTHLFDAVAPGATERLFCGGVYSSSGDAVEALKADCAAAFTAHPQYRAILQKRNELYTRLNRAMQRLGRGEEEASRESPEVPRPAGAREPGPSGALSDALKRKEQYLRQVATEGLAKLQSCLAQQSETLTETLCLRVWGDVVYWELARMRNHFLYRRAFVSGPWEDRRAGEGAAFENSKYIKTHLFTQTLSSEHLHALTHSLYTFITGPLAEESGLFPPPSNVALARCCDAAGTLPHQKAFLTSLIWPGIEPSDWIETSFNSFYSVPGGSLASSQQILCRALREAVLTVSLYNKTWGRSLILRRADAVSPGQALPPDGLYLTYDSDRPLILLYKGRGWVFKDLYALLYLHLQMRDDSA

SEQ ID NO: 17 - DNA, 2058 bp, Epstein-Barr-Virus (EBV)
atgtcggggctgctggcggcggcgtacagccaggtgtacgccctggcggttgagctgagcgtgtgcgcccggctggacccccggagtctggacgtggctgcggtagtgcgcaacgccggcctgctggccgagctggaggccatcctccttccccgtttgagacggcagaatgaccgtgcatgcagcgccctgtccctggagctggtgcacctgctagagaactcgagagaggcctctgccgcgctgctcgcccctggtagaaagggtacccgggtcccgcctctccgcaccccctcagtcgcgtactctgtggagttttacggggggcataaagtcgatgtaagtttgtgcctaataaatgacatagagattttaatgaagagaatcaatagcgtgttttattgcatgtctcacaccatggggctggagagcctggaacgggccctggatctgctgggccgctttcggggcgtaagtcccatcccagacccgcgcctctacatcacctctgtgccctgctggcgctgtgtgggcgagctgatggttctgcccaaccacggcaacccttccacggcagaggggacccacgtctcctgtaaccacctggcggtgccggtgaatccggagccggtctcgggactgtttgagaatgaagtccggcaggctgggctcgggcacctgttggaggctgaggagaaggcgaggccgggcggcccagaggagggcgcggtcccgggcccggggcggccggaggcagagggggcgaccagagcgctggacacctacaacgtcttctcgacagtgcccccggaggtggcggaactctcggagctcctctattggaactctggcggccatgctatcggtgcaacggggcagggggagggtggcggccattcccgcctctctgccctgtttgcccgggagcgtcgcctggccctggtgcggcgggcctgcgaggaggcgctggcgggggcaaggctgactcacctgtttgatgccgtggctcccggggccacggagcggctcttctgcggcggggtctacagctcctcgggcgacgcggtggaggcgctgaaggcggactgcgccgccgccttcacggcgcacccccagtaccgggccatcctgcaaaagaggaacgagctctacacgcggctcaaccgagccatgcagcggttgggccgaggcgaggaggaggcgtcccgggagagcccggaggtgccccggccggctggggcacgagagcccggcccgtccggcgccctctcggacgcgctcaagcgcaaggagcagtacctgcgccaggtggccaccgagggtctggccaagctgcagtcctgcctggcgcaacagagcgagaccctgaccgagaccctgtgcctgcgcgtctggggggacgtggtctactgggagctggcccgcatgcgcaaccacttcctctacagacgggccttcgtctcgggtccctgggaggacaggcgcgccggcgagggtgccgcctttgagaattccaagtacatcaaaacacacctgtttacccagaccctgagctcggagcacctgcacgcgctgacgcacagcctgtacaccttcatcacggggcccctggcggaggagagcgggctctttcccccacccagcaacgtggccctggctcgctgctgtgacgccgcaggtacgctgcctcaccagaaggcgttcctgacttccctgatatggccaggcatcgagccgagcgactggatagagacctccttcaacagcttctacagcgtacccgggggctcactggcatctagccagcaaattctgtgccgggcgctgcgcgaggccgtcctaaccgtgtccctctacaacaagacctgggggcggtccttgatcctgcgccgggcggacgcggtcagccccggccaggccctgcccccggatgggctttacctcacgtacgactctgaccggcccctaattcttctgtataagggcagggggtgggtatttaaggatctatatgcccttctctacctgcacctccaaatgagagatgactcggcgtag

SEQ ID NO: 18 - protein, 685 aa, Epstein-Barr-Virus (EBV)
MSGLLAAAYSQVYALAVELSVCARLDPRSLDVAAVVRNAGLLAELEAILLPRLRRQNDRACSALSLELVHLLENSREASAALLAPGRKGTRVPPLRTPSVAYSVEFYGGHKVDVSLCLINDIEILMKRINSVFYCMSHTMGLESLERALDLLGRFRGVSPIPDPRLYITSVPCWRCVGELMVLPNHGNPSTAEGTHVSCNHLAVPVNPEPVSGLFENEVRQAGLGHLLEAEEKARPGGPEEGAVPGPGRPEAEGATRALDTYNVFSTVPPEVAELSELLYWNSGGHAIGATGQGEGGGHSRLSALFARERRLALVRRACEEALAGARLTHLFDAVAPGATERLFCGGVYSSSGDAVEALKADCAAAFTAHPQYRAILQKRNELYTRLNRAMQRLGRGEEEASRESPEVPRPAGAREPGPSGALSDALKRKEQYLRQVATEGLAKLQSCLAQQSETLTETLCLRVWGDVVYWELARMRNHFLYRRAFVSGPWEDRRAGEGAAFENSKYIKTHLFTQTLSSEHLHALTHSLYTFITGPLAEESGLFPPPSNVALARCCDAAGTLPHQKAFLTSLIWPGIEPSDWIETSFNSFYSVPGGSLASSQQILCRALREAVLTVSLYNKTWGRSLILRRADAVSPGQALPPDGLYLTYDSDRPLILLYKGRGWVFKDLYALLYLHLQMRDDSA

SEQ ID NO: 19 - DNA, 408 bp, Epstein-Barr-Virus (EBV)
atgacacatctgggtggcaaggtgaggtcttctgggtttttaataccggggtcggcaccagtttctgggacaccgccacaaggacaaggtgggctagcaagttctcgagtctacgaagactccgggggcagtcttttgagtttctcgcctatgatccaccccaatctcgcccccctaattgcgccatctgcctacgcgaggctgaacctcctgaatcactgcatctttcttgaggcgtttaaagaagagaatagtggccagggcctcggtggggtccagcgtgaggtcttatttttgaaaagggatattataaaacaggtcattgctcggattgtggcagccgatagcaccctagatctagtgaatcatggcgagcccggaagagaggctcctagacgagctcaataa

SEQ ID NO: 20 - protein, 135 aa, Epstein-Barr-Virus (EBV)
MTHLGGKVRSSGFLIPGSAPVSGTPPQGQGGLASSRVYEDSGGSLLSFSPMIHPNLAPLIAPSAYARLNLLNHCIFLEAFKEENSGQGLGGVQREVLFLKRDIIKQVIARIVAADSTLDLVNHGEPGREAPRRAQ

SEQ ID NO: 21 - DNA, 408 bp, Epstein-Barr-Virus (EBV); identical to SEQ ID NO: 19

SEQ ID NO: 22 - protein, 135 aa, Epstein-Barr-Virus (EBV); identical to SEQ ID NO: 20

SEQ ID NO: 23 - DNA, 1011 bp, Epstein-Barr-Virus (EBV)
atggcgagcccggaagagaggctcctagacgagctcaataacgtaattgtgtcatttctgtgtgactctgggtctctggaagtggagagatgctccggggcgcatgtgttctccaggggcagctcccaacccctctgcaccgtgaagctgcgccacggacagatttaccacctggagtttgtctacaagttcctggcctttaagctgaagaactgcaactacccctcctcgcccgtgtttgtgatatccaacaacggcctggccaccaccctgaggtgctttttgcacgagccgtcgggtctcagatcgggccagagcggcccttgcctgggtctctcaacggatgttgacctaccaaagaactccatcattatgctgggccaggatgacttcattaagttcaaaagccccctggtcttccctgctgagcttgatctcctgaaatctatggtggtctgccgggcctacatcacggaacaccggacgacgatgcagtttctggtgtttcaggccgccaacgcccagaaggcctcgcgggtcatggatatgattagtgatatgtctcagcaactgtctcggtctggtcaagtcgaggatacgggcgccagagtcacaggtggaggaggtcccaggcctggcgtcacgcactcggggtgtcttggggactcacacgttagggggcgcggtggttgggacttggataacttttcagaagctgagaccgaagacgaggcgagttacgctccttggagggacaaagactcgtggtcggaatccgaggcggcgccgtggaagaaggaactcgtgaggcaccccatccgcaggcaccggacacgcgagactcgccgtatgcgcgggagccattcacgggtggaacacgtgccccccgagacccgggagacggtggtggggggagcatggcgttattcttggcgcgccacaccttatctggcacgggtgctggctgtcacggccgtggccctgctcctgatgtttctgaggtggacctga

SEQ ID NO: 24 - protein, 336 aa, Epstein-Barr-Virus (EBV)
MASPEERLLDELNNVIVSFLCDSGSLEVERCSGAHVFSRGSSQPLCTVKLRHGQIYHLEFVYKFLAFKLKNCNYPSSPVFVISNNGLATTLRCFLHEPSGLRSGQSGPCLGLSTDVDLPKNSIIMLGQDDFIKFKSPLVFPAELDLLKSMVVCRAYITEHRTTMQFLVFQAANAQKASRVMDMISDMSQQLSRSGQVEDTGARVTGGGGPRPGVTHSGCLGDSHVRGRGGWDLDNFSEAETEDEASYAPWRDKDSWSESEAAPWKKELVRHPIRRHRTRETRRMRGSHSRVEHVPPETRETVVGGAWRYSWRATPYLARVLAVTAVALLLMFLRWT

SEQ ID NO: 25 - DNA, 1011 bp, Epstein-Barr-Virus (EBV)
atggcgagcccggaagagaggctcctagacgagctcaataacttaattgtgtcatttctgtgtgactctgggtctctggaagtggagagatgctccggggcgcatgtgttctccaggggcagctcccaacccctctgcaccgtgaagctgcgccacggacagatttaccacctggagtttgtctacaagttcctggcctttaagctgaagaactgcaactacccttcctcgcccgtgtttgtgatatccaacaacggcctggccaccaccctgaggtgctttttgcacgagccgtcgggtctcagatcgggccagagcggcccttgcctgggtctctcaacggatgttgacctaccaaagaactccatcattatgctgggccaggatgacttcattaagttcaaaagccccctggtcttccctgctgagcttgatctcctgaaatctatggtggtctgccgggcctacatcacggaacaccggacgacgatgcagtttctggtgtttcaggccgccaacgcccagaaggcctcgcgggtcatggatatgattagtgatatgtctcagcaactgtctcggtctggtcaagtcgaggatacgggcgccagagtcacaggtggaggaggtcccaggcctggcgtcacgcactcggggtgtcttggggactcacacgttagggggcgcggtggttgggacttggataacttttcagaagctgagaccgaagacgaggcgagttacgctccttggagggacaaagactcgtggtcggaatccgaggcggcgccgtggaagaaggaactcgtgaggcaccccatccgcaggcaccggacacgcgagactcgccgtatgcgcgggagccattcacgggtggaacacgtgccccccgagacccgggagacggtggtggggggagcatggcgttattcttggcgcgccacaccttatctggcacgggtgctggctgtcacggccgtggccctgctcctgatgtttctgaggtggacctga

SEQ ID NO: 26 - protein, 336 aa, Epstein-Barr-Virus (EBV)
MASPEERLLDELNNLIVSFLCDSGSLEVERCSGAHVFSRGSSQPLCTVKLRHGQIYHLEFVYKFLAFKLKNCNYPSSPVFVISNNGLATTLRCFLHEPSGLRSGQSGPCLGLSTDVDLPKNSIIMLGQDDFIKFKSPLVFPAELDLLKSMVVCRAYITEHRTTMQFLVFQAANAQKASRVMDMISDMSQQLSRSGQVEDTGARVTGGGGPRPGVTHSGCLGDSHVRGRGGWDLDNFSEAETEDEASYAPWRDKDSWSESEAAPWKKELVRHPIRRHRTRETRRMRGSHSRVEHVPPETRETVVGGAWRYSWRATPYLARVLAVTAVALLLMFLRWT

SEQ ID NO: 27 - DNA, 183298 bp, Epstein-Barr-Virus (EBV)
agaattcgtcttgctctattcacccttacttttcttcttgcccgttctctttcttagtatgaatccagtatgcctgcctgtaattgttgcgccctacctcttttggctggcggctattgccgcctcgtgtttcacggcctcagttagtaccgttgtgaccgccaccggcttggccctctcacttctactcttggcagcagtggccagctcatatgccgctgcacaaaggaaactgctgacaccggtgacagtgcttactgcggttgtcacttgtgagtacacacgcaccatttacaatgcatgatgttcgtgagattgatctgtctctaacagttcacttcctctgcttttctcctcagtctttgcaatttgcctaacatggaggattgaggacccaccttttaattctcttctgtttgcattgctggccgcagctggcggactacaaggcatttacggttagtgtgcctctgttatgaaatgcaggtttgacttcatatgtatgccttggcatgacgtcaactttacttttatttcagttctggtgatgcttgtgctcctgatactagcgtacagaaggagatggcgccgtttgactgtttgtggcggcatcatgtttttggcatgtgtacttgtcctcatcgtcgacgctgttttgcagctgagtcccctccttggagctgtaactgtggtttccatgacgctgctgctactggctttcgtcctctggctctcttcgccagggggcctaggtactcttggtgcagcccttttaacattggcagcaggtaagccacacgtgtgacattgcttgcctttttgccacatgttttctggacacaggactaaccatgccatctctgattatagctctggcactgctagcgtcactgattttgggcacacttaacttgactacaatgttccttctcatgctcctatggacacttggtaagttttcccttcctttaactcattacttgttcttttgtaatcgcagctctaacttggcatctcttttacagtggttctcctgatttgctcttcgtgctcttcatgtccactgagcaagatccttctggcacgactgttcctatatgctctcgcactcttgttgctagcctccgcgctaatcgctggtggcagtattttgcaaacaaacttcaagagtttaagcagcactgaatttatacccagtgagtatctatttgttactcctgtttagttgaagaaaacaagctattggattgtaacacacattttacgctttgttccttagatttgttctgcatgttattactgattgtcgctggcatactcttcattcttgctatcctgaccgaatggggcagtggaaatagaacatacggtccagtttttatgtgcctcggtggcctgctcaccatggtagccggcgctgtgtggctgacggtgatgtctaacacgcttttgtctgcctggattcttacagcaggattcctgattttcctcattggtaagtgtgacaccaacaggtgttgccttgttatgtcaccgttctgacacatgacttacatgggtttggcttttgtaggctttgccctctttggggtcattagatgctgccgctactgctgctactactgccttacactggaaagtgaggagcgcccaccgaccccatatcgcaacactgtataaaggtaagtattattaaattttagagacactatcacgtgtaacttgacgtgcaaggatggaagagaggggcagggaaacgcaaatgccggttgcccggtatgggggcccgtttattatggtaaggctcttcgggcaagatggagaggcaaacatacaggaggaaaggctatatgagctactctctgacccacgctccgcgctcggcctagacccggggcccctgattgctgagaacctgctgctagtggcgctgcgtggcaccaacaacgatcccaggcctcagcgtcaggagagggccagagaactggccctcgttggcattctactaggaaacggcgagcagggtgaacacttgggcacggagagtgccctggaggcctcaggcaacaactatgtgtatgcctacggaccagactggatggcaaggccttccacatggtccgcggaaatccagcaattcctgcgactcctgggcgccacgtacgtgcttcgcgtggagatgggcaggcagtttggcttcgaggtgcatagaagccggccctccttccgtcagttccaggccatcaatcaccttgtcctgtttgacaacgcccttcgcaagtacgattccggccaggtggcggcgggcttccagagggcccttctggtggccgggccagagaccgctgacacgaggccggacctccgcaagctgaatgagtgggtgtttggtggcagggctgctggtggcagacagctggccgacgagctaaagatcgtgtccgcgctgcgagacacttactcgggccacttggtccttcagcccacggagacccttgacacatggaaggtgttgagcagggacacacgaaccgctcatagtttggagcacggattcattcatgccgcggggaccatccaggccaactgcccacagctgtttatgagacgccagcaccccggcctctttcccttcgttaatgcaatagcatcatcgctgggctggtactaccagaccgccaccggccccggagcagatgccagggcggcggcccggcgccaacaggcctttcagaccagggcggcggctgaatgccatgccaaaagcggggtgccggtcgtggccggcttctacaggaccatcaacgccacgctcaagggaggagagggcctacagcccactatgtttaacggggagctgggggccatcaagcaccaggcacttgacactgtgaggtatgactacggccactatctcataatgttggggccattccagccatggagcggactgacggcccctccgtgcccctacgccgaaagttcatgggcacaggcggccgtgcagacggccctcgagctgttctcggccctgtacccggccccgtgcatctcgggctacgcgcgccccccgggccccagtgctgtgatcgagcatctggggtccctagttccaaaggggggtctgctgttgtttctgtctcacctaccggatgatgttaaggacgggctcggagaaatggggccggccagggccacgggacctggaatgcagcagtttgtcagcagctacttcctcaaccccgcctgttccaacgtcttcattacagtgaggcagcgaggggagaagatcaacggccgtaccgtcctccaagcgctcggacgcgcatgcgatatggcaggctgccagcactatgtgctgggctccacggttcccctcggtggactcaactttgtcaacgacctggcgtccccggtttccaccgccgagatgatggatgatttctctcccttcttcaccgtggagtttcccccgattcaagaggagggcgcaagttctccggtacccttagatgtggacgagagcatggacatctctccgtcttacgagttgccctggctctcgctggagtcatgcctcacaagcatcctgtcacaccccaccgtgggaagcaaggagcacttggtcaggcacacggacagggtcagcggaggacgcgtggcacagcagcccggggtaggtcccctggacctgccgctggcggactacgccttcgttgcccacagtcaggtctggaccaggcccggtggggctcctcccttgccctatcgtacctgggatcgaatgacagagaagctgcttgtctccgcaaaacccggcggagagaacgttaaggtttcaggtaccgtgattacattgggagaacaggggtacaaagtgtcgttggatctgagggagggaaccaggctggcaatggctgaggcgctgctgaacgcagcatgtgccccaatcttggatccggaagacgtcttgctcaccctgcatctacacctggatccgcgccgggcagacaactcggccgtgatggaggctatgacggcggcgagtgactacgcgcgtggcctgggcgtgaagctgacctttggctcggcctcctgccccgagaccggctcgtccgcctccaacttcatgaccgtggtggcctctgtctccgccccaggggaattctcgggtcctctgatcacgccagtgcttcagaagacgggcagtctcctgattgcggtgcgttgcggggatggcaagatccagggagggtcgctgtttgagcagctctttagcgacgtggccacgaccccacgggcacccgaggcgttgtctctgaagaatctcttccgggcagtccagcagctggtcaagagcggcatcgtgctgtcagggcatgacatcagcgacgggggcctggtgacctgcctggtggagatggccctggccgggcagcggggagtgaccatcactatgccggtggcctccgactacctcccggagatgtttgcagagcaccccggcctggtgtttgaggtggaggagcgcagcgtgggtgaggtgctgcagaccctgcgctccatgaacatgtacccggcagtcctcggtcgagtgggcgagcaaggtccagatcaaatgtttgaggtgcagcacggcccagagacggtgttgcgccagtcgctgcgcctgctgctgggaacctggtcatcctttgccagcgagcagtacgagtgcctgcgaccagatcggattaaccggtccatgcacgtgtccgactacggctataacgaagcactggcagtctccccgttgacaggaaagaatctcagcccacgccggttggtgacagagcctgacccacgatgtcaggtggccgtgctatgcgccccgggcaccaggggccatgaaagcctcctggcggccttcacgaatgccggatgcctgtgccgacgggtgttctttcgcgaggttagggacaacacgttcctcgacaagtacgtgggtctggccatcggaggagttcatggggccagggactctgccctggcaggccgtgccaccgtggcgctgattaatcgtttccccgccctgcgtgacgctattctaaagttcctcaacaggccagatacgttctcggtggccttgggggagctgggggtgcaagttttggctggcctgggggccgtggggtcaacagataatccacccgcccctggcgtggaagttaatgtccagagatcacctctgattctggcccccaacgcctctggcatgtttgagtcccgctggctgaacattagcatcccggcgaccaccagctctgtcatgctgcgtggcctccggggctgcgtcctgccttgttgggtgcaaggctcgtgcctgggcctgcaatttactaacctcgggatgccatatgttttgcagaatgcccaccagatcgcctgccacttccacagcaatggcacggatgcctggcgctttgctatgaattatccaagaaaccccacggagcagggcaacattgcagggctctgttcacgcgatggtcgtcatctggctctcctgtgtgacccctcactttgtacagacttttggcaatgggagcacattccccccgcctttgggcaccccacggggtgctccccctggacacttatgtttcaagcagctcacctatggtcactcaggcacggtcgcccctccgagtgaccagtcaccttccagactatgcatacactgaatttagcctgatattgtccccctagccccgggcccagccctcctcagaaaactctgcatggagaagctggacgtgaacctcccccccagacctgtgtgctgtatttacaaacactacaataaacccaatgtgcaaatgtggtttgtatggctactttgtgttcctaaaaaatgcaacaatagaagtggaaaccctcagtcacgggacattaacctcaaccacaaaatgggggttggagaaagtaaccacatatactggagatgattcatgggctgggggttcccggacaatacacccatctggagttcaacctaattacatggtagataaattaagagtccctcctcaccactcgaaactatggcagacattctataagataacgaggagagatgaggtgagggcagaggacattgggcaggtgtgggccacggggcagctggccatatcccccgcactacagaagtgtaagcaaagtgaagggctcggaaggcaggcggggcctagcaatgtcacagctaaatgcccaccagggcacacactcaagcggggtctcggagctcctaggtcagaccacgaaaggtcagcctgcaaggtggatggcgtgttttctgaggttatccccgctacgtgcagtgctgggtgatagagaccctagaatgtgtcgaaatgaccaagcgtccccgcagcggggctcccaacacgggttcccagagagggtaaaagagggggccataaagcccagggtgtaaaacaccgaccgcgccaccagatggcacacgtgggggaaatgagggttagcataggcaacccccgcctacacaccaactatagcaaaccccgccccgtcacggtgacgtagtctgtcttgaggagatgtagacttgtagacactgcaaaacctcaggacctacgctgccctagaggttttgctagggaggagacgtgtgtggctgtagccacccgtcccgggtacaagtcccgggtggtgaggacggtgtctgtggttgtcttcccagactctgctttctgccgtcttcggtcaagtaccagctggtggtccgcatgttttgatccaaacttttgttttaggatttatgcatccattatcccgcagttccacctaaacggggcttaacgttgcatcccagaagatgcacgcttaaccccgcctacaaccgtgacgtagctgtttaccagcatgtatagagttacggttcgctacatcaaacaggacagccgttgccctagtggtttcggacacaccgccaacgctcagtgcggtgctaccgacccgaggtcaagtcccgggggaggagaagagaggcttcccgcctagagcatttgcaagtcaggattctctaatccctctgggagaagggtattcggcttgtccgctatttttttgtggctagttttgcacccacaacatgtaagggcccgctacccctacaacacaaaacaaactatctcccctaaccatccttttgccaatcaattctgtgacagggtttcctggacacccagtcttagttcaggtagacacccagttatgcagtgccaccaattccaaccatttttaaacctcctggaattctatcattaaacggcatgcaggaaaaggacaagcagcgaaaattcacgcccccttgggaggtggcggcatatgcaaaggatagcactcccactctactactgggtatcatatgctgactgtatatgcatgaggatagcatatgctacccggatacagattaggatagcatatactacccagatatagattaggatagcatatgctacccagatatagattaggatagcctatgctacccagatataaattaggatagcatatactacccagatatagattaggatagcatatgctacccagatatagattaggatagcctatgctacccagatatagattaggatagcatatgctacccagatatagattaggatagcatatgctatccagatatttgggtagtatatgctacccagatataaattaggatagcatatactaccctaatctctattaggatagcatatgctacccggatacagattaggatagcatatactacccagatatagattaggatagcatatgctacccagatatagattaggatagcctatgctacccagatataaattaggatagcatatactacccagatatagattaggatagcatatgctacccagatatagattaggatagcctatgctacccagatatagattaggatagcatatgctatccagatatttgggtagtatatgctacccatggcaacattagcccaccgtgctctcagcgacctcgtgaatatgaggaccaacaaccctgtgcttggcgctcaggcgcaagtgtgtgtaatttgtcctccagatcgcagcaatcgcgcccctatcttggcccgcccacctacttatgcaggtattccccggggtgccattagtggttttgtgggcaagtggtttgaccgcagtggttagcggggttacaatcagccaagttattacacccttattttacagtccaaaaccgcagggcggcgtgtgggggctgacgcgtgcccccactccacaatttcaaaaaaaagagtggccacttgtctttgtttatgggccccattggcgtggagccccgtttaattttcgggggtgttagagacaaccagtggagtccgctgctgtcggcgtccactctctttccccttgttacaaatagagtgtaacaacatggttcacctgtcttggtccctgcctgggacacatcttaataaccccagtatcatattgcactaggattatgtgttgcccatagccataaattcgtgtgagatggacatccagtctttacggcttgtccccaccccatggatttctattgttaaagatattcagaatgtttcattcctacactagtatttattgcccaaggggtttgtgagggttatattggtgtcatagcacaatgccaccactgaaccccccgtccaaattttattctgggggcgtcacctgaaaccttgttttcgagcacctcacatacaccttactgttcacaactcagcagttattctattagctaaacgaaggagaatgaagaagcaggcgaagattcaggagagttcactgcccgctccttgatcttcagccactgcccttgtgactaaaatggttcactaccctcgtggaatcctgaccccatgtaaataaaaccgtgacagctcatggggtgggagatatcgctgttccttaggacccttttactaaccctaattcgatagcatatgcttcccgttgggtaacatatgctattgaattagggttagtctggatagtatatactactacccgggaagcatatgctacccgtttagggttaacaagggggccttataaacactattgctaatgccctcttgagggtccgcttatcggtagctacacaggcccctctgattgacgttggtgtagcctcccgtagtcttcctgggcccctgggaggtacatgtcccccagcattggtgtaagagcttcagccaagagttacacataaaggcaatgttgtgttgcagtccacagactgcaaagtctgctccaggatgaaagccactcagtgttggcaaatgtgcacatccatttataaggatgtcaactacagtcagagaacccctttgtgtttggtccccccccgtgtcacatgtggaacagggcccagttggcaagttgtaccaaccaactgaagggattacatgcactgccccgcgggaaatacgtcctacccaggaacccgaaacagtgtttcccagaagctgtaaaaatagaacgccctggaactgccccactgtgcaatgcagcttttagccatgccatgctctataaatcacttccctatctcaggtaggcctgcacaccttaggtatggagcgaaggttagtggtcactctgcagtgcctggtgctgctttacctggcacctgagtgtggaggtacagaccaatgtgacaattttccccaaatgttgagggacctaagagatgccttcagtcgtgttaaaacctttttccagacaaaggacgaggtagataaccttttgctcaaggagtctctgctagaggactttaagggctaccttggatgccaggccctgtcagaaatgatccaattctacctggaggaagtcatgccacaggctgaaaaccaggaccctgaagccaaagaccatgtcaattctttgggtgaaaatctaaagaccctacggctccgcctgcgcaggtgccacaggttcctgccgtgtgagaacaagagtaaagctgtggaacagataaaaaatgcctttaacaagctgcaggaaaaaggaatttacaaagccatgagtgaatttgacatttttattaactacatagaagcatacatgacaattaaagccaggtgataattccataccctggaagcaggagatgggtgcatttcaccccaaccccccctttcgactgtcatttacaataaaatgaaaccttttattcttgattgcctcttgtgttcttgccgcccaggtaccttcctgtgttctccccacgggaaaaagaatagcttctgcagaaggccattgacgcaagttttgcccgtggggattacccgacccagccacttacagcacattttgttctaggtccatcttaggagcccgggccagcattctatcagcttaacgggaagagaagtggggagggcactcgcccactaaccttaacacctgcagcctacaaaagtacactagctgtttgctctattcgccactagagaccgccaagatgcgaaactacaggcccgggcccaggccttgcagggcagacggttaggctgacaaggggacaagtgtggcaggtgggcgggaaggggcacaagaatgccggcgaaactggaccacggtccaccccgccctcaagcgtccgggagccgggcggctcggctaaggagggcggccttgcgaacaattattagtagctaccaacaagggcccccagatgccccccaccagtcacccggccgtgtccactcacatattccactcttatttttaaattaatgtgtcccaattagaaacccaagcgcagaaattagttgagaggctagtgttttaaacatgcaccctaggccagccagagataatgtcacaagattatcaagttggtgtaaacacgccgtgggaaaaaatttatggttcagtgcgtcgagtgctatctttggaacagtagaaaattgaaccttgttggcgggagaaggaataacgccttatctgggaggagcgacggattatagccaataagagagctcaagacgcagggctcgcaaagtatagtggccccgtgggaccttagaggtggagcaacgtctaaagtggtaataacaccaggcggggctgggcaaaggggtcctacgggcgggattaattacgccttgcttacgcaagctcagttaattcgcccacgacttgaaaaatgtagcccttaaccaattggcggcccctaagggggggactaaggtcccactacaaaaactctgtgttctgctgcaaattttagatcagatggcatagagacaaggacaccgaagacccccagagccctcatcgcagggttcttaccatgcggccatgtaggcccacttaacactacaagacctacgcctctccattcatcatgtaacccacaaatcatctaaaccgtaagtctaagggcctcctgaggttttctcaggaggccctaatgtataattaatcatgcatttgattttaaaaaagtaggttacactcattttaggccagactttatttgcagattaataatttatgtgattctccttccctctaggactgaagaaacagcctcctgcacgtgagcatgtatctgaaataattattatgtcataagtgtaatgattagaaagtcataaacccacttccctttacatgaatctgggcactgaattttggggtacttctaaagactaacgtgttcgatttcggggtcacttccccttttataagtgtgtgaacagtgatttcagtaaaacctaagagatatttggtgtcacttccgcattttaagtttcagaaaattttaaaattaaaattgaaatttctctcaaaataattccaatgaaaacttcaaagaatcttatgtatgtaattcttttgccccaaactgggcttcagatgccttctattgcactctcacaaaaacattctggacacatgtgccagacgcctgggcctctaaggccctcgggtccccctggaccccggcctcagcaaccctgctgctcccctcctgccaccccagcctccccccctccccgtcccccttcgctcctgttcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctctcgcccaagctgctttgattcctgggatatttttgggaatggtgttaactttctccccttgtatttgctattcaatcaacctgattccccctgctcatacctccacttacaaccaagccactacggccacgtccccggcctcccgctcgggtaagtgctttttcatttttagccccagcccctcctctataagttctaggcaaacctccaatcaccagccaccttccaatgtagtctcttagagagtggctgctacgcattagagaccactttgagccacccacagtaaccacccagcgccaatctgtctacatagaagaagaagaggatgaagactaagtcacaggcttagccaggtgatttgtgaatttcagtttatttactttcttccaatcaagctttcccagcctccgcttgttaggtcctagttatgggttttccatgggggacttagtatccgttctattagattaacgtgcaagacgctaaacttaaccaaggtcagccaagggacgcgtgttatcccaggctgcccaccctgaggatttccccccaaaatcctcctaccctctctttatgccatgtgtgttgttggcttgtgttagtgctatgtaatgcgttgccgccaggtggcagcctgtttatagatgtgcagtaccccttaatgttaggtctgctttagggctgccaggtggcgcaatctaggattaattcacctgtatccctttccctccacccgcagtaacccagcactggcgtgtgacgtggtgtaaagttttgcctgaacctgtggttgggcaggtacatgccaacaaccttctaagcacccgcgcttgtgttttgctttatctgccgccatcatgcctacattctatcttgcgttacatgggggacaaacatatcatctaattgttgacacggatagtcttggaaacccgtcactctcagtaattccctcgaatccctaccaggaacaactgtcagacactccattaattccactaacaatctttgttggggaaaacacgggggtgcccccaccactcccaccaccccccccaccaccacccccaccacccccaccacccccaccacccccaccacccccaccacctccaccaccttcaccaccacccccgcccccaccacccccaccacctcagcgcagggatgcctggacacaagagccatcacctcttgatagggatccgctaggatatgacgtcgggcatggacctctagcatctgctatgcgaatgctttggatggctaattatattgtaagacaatcacggggtgaccggggccttattttgccacaaggcccacaaacagcccctcaggccaggttggtccagccacatgtcccccctctacgcccgacagcacccaccattttgtcacctctgtcacaaccgaggcttacccctccacaaccactcatgatgccaccaaggcctacccctcctacccctctgccacctgcaacactaacggtgccaccaaggcctacccgtcctaccactctgccacccacaccactactcacggtactacaaaggcctaccgaacttcaacccacaccatcaccaccacgcatgcatctccctgtcttgcatgtgccagaccaatcaatgcaccctcttactcatcaaagcaccccaaatgatccagatagtccagaaccacggtccccgactgtattttataacattccacctatgccattacccccctcacaattgccaccaccagcagcaccagcacagccacctccaggggtcatcaacgaccaacaattacatcatctaccctcggggccaccatggtggccacccatctgcgaccccccgcaaccctctaagactcaaggccagagccggggacagagcagggggaggggcaggggcaggggcaggggcaggggcaagggcaagtccagggacaagcaacgcaagcccggtggaccttggagaccagagccaaacacctccagtcctagcatgcctgaactaagtccagtcctcggtcttcatcagggacaaggggctggggactcaccaactcctggcccatccaatgccgcccccgtttgtagaaattcacacacggcaacccctaacgtttcaccaatacatgaaccggagtcccataatagcccagaggctcccattctcttccccgatgattggtatcctccatctatagaccccgcagacttagacgaaagttgggattacatttttgagacaacagaatctcctagctcagatgaagattatgtggagggacccagtaaaagacctcgcccctccatccagtaaaaacccttgccctctccagcaaccaatgtatcccaaataaatgttacttcttttgctcttaaccattgacacgcctgtcattctatcaattaaacaagggaaaaaggtttagctattccaccaacacgaccccaaggaaggcttgccaaaattggtgccttgctctcagcactttgccagcaacttatagcatggtaggcagctcaactcggcccgtcttactgcccagcctactctccactcccagtccatgttcgcactcctatgcatttcctgccctcccacttttaccccagtcccaacccaaaaccacacacaacacatagaattgttagtttaaacagtttattgataggtggctgcttttagcctaattgtgtattgctctcgttgccaaaacctgttgtaagggccggcacccgcaacatggggaaaacataaccgccgccatcccatggggagggtagaggcggttgacatgtaggtgagtagtgtaagaagcatggcgaagtagacaggttacttttagagtgtagtgtacagggccgggcgcaacagtgccaccaacccggggtctgagcattccatgggcagcagggacactgcactaccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccactgcacctggaatgcagggtgggggcgtggtcccctggaccccagccccgccgatccctcccccagggcgtacccggcttgcctggttctggggctcctctgggggtcgctgcatccgccggtagggttcgaatgggcgtggtccgcttgctctgctggcccggtacgcctggattgccggctgggggctggggtcccgggacgccccctccctgctcccacccggttccctcccccagggcgtgccccgcttgcctggtcctggagctcatccggggatgctgcatccgctagtccgacctgggtgggtgcggtccgctggccccaccctgggggtagccgccgggtctgctggtccggtgcacctggaaggcaggggggggggcagtgagggaggggcgtggtcctgggaccccgcgccgactggcagggggtccccatggcacaggcctaggggtccagggggcagccgcggcccagcgcgccccgttcacgggggaggaccgcggccgagccaccaggggcccggcgggggtggggggtgcgctcccaggccggaccctggtgccaggcagggaccccgcgccacccgcttcatggggggggaggccgccgcaaggacgccgggccggctgggaggtgtgcaccccccgagcgtctggacgacgctggcgagccgggccggctcgccttcttttatcctctttttggggtctctgtgtaatactttaaggtttgctcaggagtgggggcttcttattggttaattcaggtgtgtcattttagcccgttgggtttcattaaggtgtgtcaccaggtgggtggtacctggaggttattctattgggataacgagaggaggaggggctagaggtccgcgagatttggggtaggcggagcctcaggagggtcccctccatagggttgaaccaggagggggaggattgggctccgccccgatatacctagtgggtggagcctagaggtaggtatccatagggttccattatcctggaggtatcctaagctccgcccctatataccaggtgggtggagctaggtaggattcagctaggttcctactggggtacccccctaccctaccttaaggtgcgccacccttcctccttccgttttaatggtagaataacctataggttattaacctagtggtggaatagggtattgcagctgggtatatacctataggtatatagaacctagaggaagggaaccctatagtgtaatccctcccccccctacccccccctcccttacggttgcctgagcccatcccccaccccagcaccccggggtgacgtggcaccccgcgtgccttactgacttgtcacctttgcacatttggtcagctgaccgatgctcgccacttcctgggtcatgacctggcctgtgccttgtcccgtggacaatgtccctccagcgtggtggctgcctttgggatgcatcactttgagccactaagcccccgttgctcgccttgcctgcctcaccatgacacactaagcccctgctaatccatgagccccgcctttaggaagcaccacgtcccggggacggaaggggacttggggtgattttctatgtgggggtggaaatatgagcaagaataaggacggctccttattaacctgatcagccccggagttgcctgtttcatcactaaccccgggcctgaagaggttgacaagaagggtcaaggtttcgtctgtgtgttgaagggcaggggctgttgggtgcatctggaacggcttacctcgggtaactgtttgccattaaaaggttggggattaggtttagcccctttagctgccatttcgaaccggggtgtgcagatgcaggtctccgggtgggcaggcagtacgagatgtcacgttgtgttgtctttcctcccacccctgtcctggctgtggcaaatgcgaccctcatagagttgtgtttcaggtctgtgtcctgttttgcggtgggttatttcttccctcagtgtttgccagcttatttccccagttttcacgtactggggcctgtggacacctgagggagcggccgttggtgggtatgtgttggaattgctcccaccctcaattttcgcttgccttcttcccttgttaacctgatagcatagcctctaggtttccttgtaggtctgtttgggtttgttggttcacgtggtgctaacttgaattttttggttttctagttccctcttaattacatttgtgccagatcttgtagagcaagatggcctattcaacaagggagatactgttagccctgtgtatacgggacagtcgtgtgcatggaaatggtaccctgcatcctgtgttggagctagcagcaagagaaacacctctccgcctttcgccagaggacactgtagttctgcgttatcatgtgttgcttgaggagataattgaacgaaattcagagacatttacagaaacttggaacagatttataacacacaccgaacatgtggatctggattttaactcagtatttttagagatatttcaccgtggagacccaagccttgggcgcgcgttggcctggatggcctggtgcatgcatgcctgcaggacattgtgttgtaaccagtctactccttactatgttgtggacctgtcagttcgtgggatgttagaagccagcgaaggcctggatggttggattcatcaacagggcggctggtctacattaattgaagacaacattcctggatccagaaggtttagctggactttgtttcttgctggactgactttgagtctgttagttatatgtagttatttatttatctccagaggaagacactaatctatacattttctcagcactttatatgaatcagggtcattgggcctgcggggaactgagccagtaggatattaggcaagggtgacacagtgcccatgcattataatttaaccaaacagtggtcgtgagttttaggccggccatgggggcttacaagaataacatgccaatgacccggcccccacttttaaattctgttgcagcagatagctgatacccaatgttatcttttgcggcagaaattgaaagtgctggccatatctacaattgggtgtcctaggtgggatatacgcctgtggtgttctaacgggaagtgtgtaagcacacacgtaatttgcaagcggtgcttcacgctcttcgttaaaataacacaaggacaagatactaaagaaataactgaggtgagtgtgggaagatgggaatactatgtgttatgttaacgggtgagagcctatactgcagcccagactcggggggaggaggaaatggtaagagttatactctacttatcttttttgacactacatttaactgttatgtaacaatgtttgcttattttcatgttcaataaacgctatgttaatgatgaagaacctgtgttctttggaagtgggcccaatggggtagtaggttttgggagggtgccgtgctagatatttcaactgccacagaccccattttgtcccacctgttaccacattctaggtcctgcatccagtgggccaggtgtctcaccatggctctttctaggtggataccacagtccaggcccccaaggctaccgtgctaattacctcctcatgtccacccccaccctgtgttactgtcgcctgattatcctggcttagcagcctccaagttttacaagacgtcccattgccctgcccttggtccaagtctcgccggttttcagcagcctgttgtagcctgcccccaagtttcgcaggtttcccccatgcttccacccgttaacccaatagcatgacagccaatccaacacgaggcaagttttaagagttaaaagcaactactgtttattttccaaaatgagctgggtatagttgatgatctgtaggcgcagctcatccccacattccaggtccttgatggcctcgtagatggcatcttcgtcgacattgacagccttctcatataccgtgtctctggggctgacctttatacagaaggcgtcccctactaggtccacggccagctcgtaggtggggcctatgttttcacataacagtttcaagcaggtctctgggatgtgaagggaggtgccctggagcaggagatgcatgattaggcgcccttttccatttgtgctgaagatggggcagatggtgccacaaaagtgtccggtgaccaggtaagcgtagagaaggctgggttgggaaagtccagcctttactgcactgggagagctgctgagcagagacacatagaaggtcttgttgggtattatcttgtggacattgttgaagaaggagagctgggtggagctaaactcctgaggcacatgaacctgggacctattgatgcagatctcgcagtgagaccccagagtcaggctgtggccgaagggagacaggcgaaggcagcgcccgggggagagagtgcacagtgacagtgggagaaacacggcctctgagacatgtatgggggtgttcatctcacgcagaaaatctttgcccagctcaaagttggcagagattcccctgaagaagtcccgtagtgaaaaatgggatctgtctacaccatgtctggtgtgccgggaacatattgatcgggccacactgccaaccctttccattcttcccagctctgagcgagattttccacacctggacaccgacttcacgctatgcgccgaggcctttgaggccgtgtagtttctgtggtgcggatgcattaggcggcgcaatgcgggatctgccggtcgctgttggcgtgcattcacggcatctggggtgaccggggccatcgggtttacttttcacacgtagacctgggaagtttgataggactgtaccaggtcaaggccgtggatgcgcaggaccacgtccagttccttagtgacatccacgaggattgttttgcccactctggccacttgtgtggatttaaatatgtacacaagcgtaattaacgagtcacagaccccctgttccagattctgaacagctatgaccatgattacgccaagcttcaaaagcgctctgaagttcctatactttctagagaataggaacttcggaataggaacttcaagatccccagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacagcttcaaaagcgctctgaagttcctatactttctagagaataggaacttcggaataggaacttcaagatccccgggtaccgagctcgaattcactggccgtcgttttacaacgtcgtgactggccggggtcggcaccagtttctgggacaccgccacaaggacaaggtgggctagcaagttctcgagtctacgaagactccgggggcagtcttttgagtttctcgcctatgatccaccccaatctcgcccccctaattgcgccatctgcctacgcgaggctgaacctcctgaatcactgcatctttcttgaggcgtttaaagaagagaatagtggccagggcctcggtggggtccagcgtgaggtcttatttttgaaaagggatattataaaacaggtcattgctcggattgtggcagccgatagcaccctagatctagtgaatcatggcgagcccggaagagaggctcctagacgagctcaataacgtaattgtgtcatttctgtgtgactctgggtctctggaagtggagagatgctccggggcgcatgtgttctccaggggcagctcccaacccctctgcaccgtgaagctgcgccacggacagatttaccacctggagtttgtctacaagttcctggcctttaagctgaagaactgcaactacccctcctcgcccgtgtttgtgatatccaacaacggcctggccaccaccctgaggtgctttttgcacgagccgtcgggtctcagatcgggccagagcggcccttgcctgggtctctcaacggatgttgacctaccaaagaactccatcattatgctgggccaggatgacttcattaagttcaaaagccccctggtcttccctgctgagcttgatctcctgaaatctatggtggtctgccgggcctacatcacggaacaccggacgacgatgcagtttctggtgtttcaggccgccaacgcccagaaggcctcgcgggtcatggatatgattagtgatatgtctcagcaactgtctcggtctggtcaagtcgaggatacgggcgccagagtcacaggtggaggaggtcccaggcctggcgtcacgcactcggggtgtcttggggactcacacgttagggggcgcggtggttgggacttggataacttttcagaagctgagaccgaagacgaggcgagttacgctccttggagggacaaagactcgtggtcggaatccgaggcggcgccgtggaagaaggaactcgtgaggcaccccatccgcaggcaccggacacgcgagactcgccgtatgcgcgggagccattcacgggtggaacacgtgccccccgagacccgggagacggtggtggggggagcatggcgttattcttggcgcgccacaccttatctggcacgggtgctggctgtcacggccgtggccctgctcctgatgtttctgaggtggacctgacgttgcaggcccttggggagcgggggttctccaggctcctggatctggggctggcctgcctggatctgagctatgtggaaatgagggaatttgtggtttggggcaggcccccagcttctgaggcggctgtggcctctacgccaggctcgcttttccgaagccactcgtccgcctactggttgtcggaggtggagaggcccgggggccttgtccgctgggccaggtcacagaccagcccctcatccctgaccctcgcgccccatcttggcccgtccctcttgtccctttcagtggtcaccggtggtgggtgtggagccgtggccttttgcaacgcctttttcctagcttattttttggttgtgcggtctgttttccccgcgttttccgatagaatagctgcctggatctgcgaccggtcccctttctgcgaaaacacccgggccgtggccaggggttaccgaggcctcgtgaagaggttcttggcattcgtgtttgagcgtagtagctatgacccccccttgttgaggcaaaactctaggcctgtggagcgctgctttgccatcaagaattatgtcccgggcctggactcacaaagctgtgtgacggtcccgagcttctcccgctgggcccagtctcacgccagcgagctcgatccccgggagattcgcgacagagttacaccagcgactgcaccttcgttcgtggctgatcatgcctcggctctattggcctccctccagaagaaggcctccgacaccccctgtgggaatcccattcagtggatgtggtaccgcctgttggtaaactcgtgcctgaggagtgcccactgtcttctgcctatacctgccgtctctgagggggggagaaagacgggcgggggcgtaggggaggagctcgtgggggccggggggccctgcctgagccgggatgttttcgtggcgatcgtaagccgcaatgttctctcgtgtctgctgaacgtgcctgccgcgggtccccgggcctacaagtgtttcagatcccacgcctccagaccggtgtctggcccggattaccctcccttggccgtgttttgcatggactgcggttactgcttgaactttggaaagcagacaggtgtaggaggcaggctcaattcctttagacccactctccagttttatccccgtgaccagaaggagaagcatgtgctgacctgccatgccagcggccgtgtgtactgctccaactgcggctctgcggcggtgggctgccagaggctggctgagccaccgagcgcccgctcgggctggcggccccgaatccgggcagtgctgccgcacaacgcggcctacgagctcgaccgtggctcccgcctcttggatgccatcatcccctgcttgggacccgaccgcacttgcatgcggccggtggtcctgcggggggtgacggtcaggcagctcctgtatttaactttgcggacagaggccagagccgtttgctccatctgtcagcaacgccaagctccagaggacgcccgcgacgagcctcacctgttctcctcctgtttagaggtagaattgccacctggtgagcggtgtgcgggctgccgtctctatcagacgcgttatggcacgccggctgcccaagcccaccctccaggggaggctggaggcggattttccagacagtcccctgcttcctaaatttcaagagctgaaccagaataatctccccaatgatgtttttcgggaggctcaaagaagttacctggtatttctgacatcccagttctgctacgaagagtacgtgcagaggacttttggggtgcctcggcgccaacgcgccatagacaagaggcagagagccagtgtggctggggctggtgctcatgcacaccttggcgggtcatccgccacccccgtccagcaggctcaggccgccgcatccgctgggaccggggccttggcatcatcagcgccgtccacggccgtagcccagtccgcgaccccctctgtttcttcatctattagcagcctccgggccgcgacttcgggggcgactgccgccgcctccgccgccgcagccgtcgataccgggtcaggtggcgggggacaaccccacgacaccgccccacgcggggcacgtaagaaacagtagagggcacgaaacatggtgtatgcactttattaataaacaattacagatacaaaaacttgagtctctcgaggtctgcgatgaggcggtgggtggaacgctccagcttgcggcgaagctggctcacgaagcgagacagtactcggctagcctgactaagggtgaggctataacgcaggtcctgttccggggcggcggtggatagagaggagggggatccggaggggaccactaggtcgccggaggtcgaccctcctgtcaccacctccctgataatgtcttcaatagacagaaattgggtgaccactgagggagtgttccacagtaatgttgtctggtcgctagatggcgcgggtgaggccacgctttgcgaaaacgaaagtgcttgaaaaggcgcgggatagcgtgcgctaccggatggcgggtaatacatgctatccttacattttggcattttgggcagctgggaggcggcggatgggggtgcttcttttcgcacggtgtatgtttggggacccgcatgccggtactgggataggcgcacctcgggccgcgcgccaggctccgagccggaatgcattgggggcaatgggattgcgggggattgttgctgtctgctcctgacagggagagacacgcgcggcggagatgcagccgacggcggggccgcggtgggctgcccccgaggacgggcgccggccgccagcgcccccgtggcctttggcacgggcctggcacccaccgctttaattgtgggggtgggcagggcagctgcatcttggggcctttgtgcttgcgttttttgggggcgcggtgccaatgcaccaactggggtgtgcgccggggcggccaagccggaccccagggcgggtgcctgggggatgggaaagccggacggcgcttctcccgggtcgaacgctggagtagcggaggctgctgcgccggcggccaccacgggcgcacggggtcgcagcccgacggccgtggggaggcgggtggcggagggccgaatctccgcggcttcttcccggcccccctgctgtttcttctcccgttgcatgatagaatggccatagggtgggtcctgagaggaggcttgtgtgtcctggggctggagcccaaaagtcgttaaagatgccgctgatggtgtgggagctatgcctcccgtcgactggccgggcttgtagggggctgagggtggataactgggcttctgtgaaggcaccaaccctggaatctggatggtatgtttcttctgtgaccccgaggcagtcgatggtgtagagtgtggagacaatgtgtagacgatgggcccttgttcagaagcccagggacttgaggggggctgttgtggtgctggttggggaaggagctccagggaatctttgggccatggccttggggagcttcccggagaccggtctgggctctcggaagccctcgtttcggccccgaaatagggccttgccatcaatcgggggcctgggagagtgatgggggcggccaatcccggggtaactgtcacgtcccggggggaggaggtaggagacagccagtccctgggcctgccaggggccaccttctctaagagggggctctgtgggctgggagggccagaggcctcagattcagcagtagtgctccccttttccccctggtccgtctcccctcctcccaactgctggagccggtcggaggaggccggggtgttatctgctgactgaaacccgtccccgctgaccagtccgtgccccacccttggggggaaaccggagaacagctcctggacgttgcgtggattcgggggaagctggtatccaaccggcagtggaggatcttcgtgctcgtagaaggaggggttgagtacatcggtcggccatcgtgaggccccggccgcgttaaagtagaactgcacgtccggcagattgtgccgataggtgaaacacttccagatgatgttttttctgttggccaggatggccacggtggggggcctggcctccttaggtttggcggccctggcctcggtgagaagctcgcgtagccacacggcctggcgtgcaaagatggacatctctggctcgaaagactcggagtagccgtccaggtcctgcagaaaattcagcgagatggtctccaccagggaccggaagggctcagagtgcccgtcgcagtagaggaggggagcaacgaccctgacctgtcccagggtcttcaggttaaacagatattgagaggagacaaagagagttaggggccgaccgaggaaggccgccgccacggccgcctcaaaaacggagacggggatggtgtcaccggagcccctcttaggaccggtaatgggagtgccataaggcataagatttctcagggcccggccggtaacggtgccgtaggaagacggggtttcgcgggggacctcgagtccctccgccctggggagctcttctccgcgtgtataggcctgcttcacaaagtcgcgcaggtagtcctgaaatgcgaccgggccctccagcgggcgcaatgagtgccagagctgctgaagggcctcgggggcgaagcaccggcgtgcgaggagcagcatgcaggctcgggcgcgggccgtactttggttgtggaccaggcccaagaactcggggtgcggccagagggcggctcgggtatccatctcctcccaggcgtcctggaagaagatgaagccggtgggtggaccggcgatgcggtggcgggtgaggcggcgcgcgtcttccccgtcgttgctgccgcgggtggttgagggcatgccccccctcccggaggctggactcctgaccagcctgtaggtgaggaccgagtccgacaggaggtctcccaaacccccatctctcgctagagccgagaccaggccgagtcctgcgtagaacgatggggcgcccaggaaggcggcagcgtaggccggatgtgtgccgaccagcagcgccatcatctcccgttgttccaatagaataacttcccggtctgtggccggggctggataaggggggtgattcctagaggcgatgagactggcgtgcgctaaaagtgtcatggccacaatggggttgtctgccaggtcttccatcagggctttgggcgcagagacgtattcccgaagcagctccccggcgttggactccacgtcgggccaggtgtcccagtaggagtcggcggcggcggcgctgaggcgggcggaagctacactggccagggttcttctcctcctctcttggtcatcctgcgggggaccaatagcttgggggcgtccggctggggtcagggaaaaggcctctgggttctccagcacggtgggcatgacatattccagaaagttgtggtagacggggatgtagttgagcggctcctgggtgtctgcggagacgtaggccgggttaagggggtcgcagggagactctgtttccagccagagggtgccggcgtatttcgccggccctgccgccgccagaaattgtgcccgccgggtcggggctccattgccccatccagttggtggtgccgaaatcgtgatgaggaggggcaggttgttggtcaagggatgcttaacgaaaacggtaggctgggcggtctcgtaaaaagccaggaaactctgcttggccgaggcatagcgcagcagcttgtccttgaggagggcatactgggagccagccgaggccccaagcgccaggcccctggcagcctccaccacgatcttgagctggcgcgggtcggtgtggcccctggcctgggtgaccagatcctgcagcgttccctgcagctgggactcttcctgggcctcctggatgatggcctccagtcgggagaggcgccttttccagtctgcgacggtctccttgccccccgcgacccgcttggggtccaacgtggccagagccaacctcagctcctccatgccatccatggagttctgggccatgccctcgacttccaggagccgtgttagctcatgaatttcaccgtcagccgcagcggctaggttcagccaggcacccgcgcccccagctaaggccagggctccttcggaaagaccccgcacggcctcgcagatgccccggatccacttggcggctgccagggatttccggtagggccatgagccgttcccggccgctgcccgggccagggcggcctcgaggggagcctggacaggggctttgggcggggagggaagcaggctccggagttcatcgtcgggggcttcgtcgcgtgacctggagaggacggcctccagagccgtgtgaaagccccgccgagtgcttgccgccatctcgtgggccttcgccatcagggtctggctctcccggacctgctcttccagcgcccggacctcggccgcctcggcctcggtcagcagctccgagaagaagtcccccgtggcctggaggagatcgtcccgctctcgccttgtcagcagctggggcttcttaggccagagcgccgagtccgaggccagcctgggcggggcggttgcctgggggatagttggaggaggaggcaggttagcctggcctgggtcattagtggcttcgggtagcgtccgatccacgtactcgctcacgatggccgtcagggcagcctcggctgctcgtcttttttccagaagcccggccagcccccgctcgtactccgcgtagggggcctccagatccgtgttgaccaccgctgatttcatgtccggggactgcagggcctggcgcgtctgcgcgagggccgaacggatggcatcggccgccgtcctggcgcgaaagagggccccggccgcttcctccgctcctcgccctcctcctccttctttggcggtagccgcgggggtggcgggccaagcgtccagtctggccagagggccggtctcgatatccgtgaaccagccgggttccgcggcctccattctctccgccgcaccaccatcgtccacgagcagggatcgcagtctctccctcctcaccctcgttattcccaatagcatagcggcaaggatctgtgtgagggagtccaagatgtccgtgtttctggctactgccgccgctgctgccgcggctgagtccgtattgtctggcagcagggaggccagcagggtgttccagtcatcgggcgaagtgggagcgggctctgggcgtgcccccagcgccttcctaattctggcccaggcctcattcgcctctcgcgctcgccgctcctgcctctccttgtcttcctgttctcggagcttctccttttccttgcgcccggtctccataagctgccgcagcttcttctcatactgtcgcttgagctctttgttgggggcagtgtccagaaaggcctcgagctgttcctcggtggcgggcttaaagccttcggcctccaggcgccaggcctgcacctccttctgtctgagctgatcgttgttgttattcttcaatttctgcaggtaacttaggaagcgtttcttgagcttccctgggatgagcgtttgggagagctgattctgcagcccagagagtagtctcagggcatcctctggagcctgacctgtgatcgtcgcatcatagaccgccagtagacctgggagcagattcaccgccgcggccgtctcctttaaggtgctgtgagtagcaaaattctgcaaggccactaggcgcgctggctccagcgtcagccggttgcccatctcgaatgtgtgcagggcctctgagaccatggggtccaggatgcggtcaatgccatcctgcacctcagggtcaaggaccggcaagtcacgatagaggtggtctatgctctcctcgaaggaggcaatgtagttatcgatggtgtagaaggtgatggatttcaggatgttcatcaggtactttttggagcgaacaatctgctgtatagtgtcacgtaggcggatgtacgtggggttctttgcggccccgactatcgaccctgcatttgcgatgtacttttctatgacggggatggtgagggccgcggtgtcggccagcggtggcgtggcttcggggttgtcgtggttggcgggtgtcgcagagggagaggcgggagagatgggggcgcctggggccgaggccacaccggccaggcccaacattgcctcgatgtcgtccaggatggtgcggaggcgcttttcgttttctctggtggtctcgagctccttctgttttttcgcgactgtctcaaactctggaaggggggcaatgctggggtcgtcctcctcaactcgctccaggggccaggggataccgctcatatcactaagggcggtgcccaggtagaggagctcgcgatagtcccattcaatggacgtgtaccggatgtttaggagaggcagggaggcgatgatctggcatgtgtgccgcaggtgtgtcaggaggtcgtcaaaatccatcactgttgggaggcttgggtcctcaaggtaggagagataatcggaggccgccgaggccaccttgtccctgatgtccgccgtacacctgcgcacgtgcagggccgcattcttggaccggacggccacgttgtggacaaaggggggcactgaggcggcgggaggggccccatactctatcgctgtcaacagcgccaaaaagcggacgtcctcctcatctaccccagcctgttgtctggccacggccgttcgggcggcctccgccagggataggaggcgcttccagctttcgtcgtccaggaccaaggggacgtccacgtgcgggcccctgtagatggaattatcctcgggttctcctcctccttcccccgcctcctgatctccgcccgagagcaggtcggtcaggcgtctgcgggccgcctccaggtcaaattttccatcgtcgctctcggccagctggggaatttcagccagcatcttagcaccggcatctacacggaccgcgtccttcgtggccagggacggcaggcaggcctccagctttgcggccaggtgcttatggaactctcccgctcttcccttgttttctgatagcatgtttgcgaggttttggatgttaagttcggaagtgagcagttgctccaggtccagcgtggggacctgcagatgtcccgaccagtcctttaagaattccagcagatttagcacagacgatcggtccctactccttattagcccctgctcgaggaccactgtcacaagaagatagtctatcatgctcaaggcatctgcctctggcacttcccggttagaggccgggtcgtagacgatggcctgttcctggtaggtatgtccggctattctcgcaatgttgctctcgaggggcacaaagtccatctcaggagtctctatgtcaaaggtggtctgatagtattggctcctggcggtgtccagtgtgatgggggacgtgggggcactggatcccgattccaggctgttggagaacacttcatcttcgaacatgtcttcatcctctgtggtggggatatcggaggctaagtcgctctccgcttcttcagagtcggacatggataggaaaggctcctctaggtcagacaggtagcggacgaggccagaacccccagatgcatcatccccaaaggagggctgctgcccgaagggaggtgatggggatatctccgttccagccctgtcagcggccgggggatggtttttttctggttcgagtgtcgtggctgatggtgggagctgctgagcaggaggaggagccggggtagctgatggcaggggctgctgctgaggaggaagaggagaaggagcccgggcggctgatggcgggggctgctgctgaggaagaagtggagaaggagccggggcggctgatggcgtgggctgctgctgaggaagaagtggagaaggagccggggcggctgattgcgggggctgctgctgagttggaggaggagaaagagtcgtggtggtgggggctgctgctgcagtcggggaaggggatggggtggtcagagggatttttgggttcgagggagctgcctgtggcagagggatgggtatttgcaaagggaggcgaggagatggagtgactgaaggagcgatagttgagactggcgcggggtggggtgtcggggaggcgggtggtgattggtgagggatggggattactggagggggaaggcgagctgctgaaggggggcgatggggcggaacgtgggtgcgtggcagctgatcatcctctgtgtcagtggtggaggacagagggaggcggcggccggaggtgggcttcttgtgggggctatctttgcccaatccctttttcctcttgggagtctgaggcgctgcgccgctcgacgcccttggtggcgtggagggagcggggaccccgggggtgtgacctaggccggggatggggatgaagaggggagggctggaggccggggccgcggaggccggggccgcggaggccggggccgcggaggccggggccgcggaggccggggccgcggaggccggggccgcagaggccggggccgcagaggccggggccgcagaggccggagacgacggcggggagttggtctttgcaggactatacctggcggcagggaatgagtcggatgtgaaagatcgagagggcagtggcctgaggttatacggtattattcgccgttcaaacggtagcatgacgggagggctgctatcagcaccgggcgtccccgccgcctccccatcactggacacaagctcgggccccaccaggtcaaagccgctgccgttggcctcataaaagtcatacacgccatagtgttccagcataaagatgcgggggtcctctgtctcaaaggcctcgggtagaaaatagagatgcacgcaagtgtactgggcccctggtgcccccacgtactgcaggatgtcgtgcgcataggtgctgactctgacatgggcgggggtgcccggggccgcatccttctggcagtgggggtcaaacaagtagaaggagccatctgtctcgatgatgatggcccccgcgtagatgtcgcagatgtagaggatgaactgggccaccccgttgtaactgccgtgcaggacctcggccagggactgaacaactgccgagtttgcgatctgggcagggaataggacgaggccaaagatctccgccgagcggtatatgtgcacgcgcccaccgcccctcaggaccacggagctgggcacgtccgtcaactgggccatctcgtgccccttgaggatgccgctctggcgcatgagggcatccagccgcgccccctcgtccaggacctcgtccagctcagggcgggaggtcagggggcggccggccaggaagctcttgaccaggtagaggacgcagttgctgacgcactggatgccggcaaagcggccaaacttgcagtgggcctggttgcacgaggccgtgcctaggatgcggagggccgagcctccactcccgcccccgggggcattcacatccatggtcctgattccgcgcacggggccggttccccgggtgcgctggctttgcccccagtcgccgttactcatcttcggcggtggggcggggaggacgccttgtcgccccccttctggtccggggtcttacgcggctggcggcggcagccgccgagagataaggggggtacgtgtgtgcctccgcctctcctctgtctgggccgccgccgccgcttgcccgccttgaaggagagggggtagtccgcggactgcgtctgcgggggcaggaggtctcaaccttctgggctcgggccgcggtgtcgatatccgatggcctttccctgtcttcctcgtatgctccttctcctcctcctcccggcacgcccctgagatctgcctcccctccctctccctcgtcctggtcggaaaagtctgaggaggagaaggagaatggggaggagtccaaaacggcacgccacctgccgtggggcggtggtgacaggtcccggctggcccggcgcttgctcgcgttcctgccgttacccaggagaatggccgcgagttttttggcggggaggatgcggaatggcgggggcgtttgtcccacgggtgagggggaatcgtcggttagggccggcacgaggtggtgggtctggacccgggccgtgcgagcaaaggcggcgagaaccgaggggcttctgggggtgactgtgatctgttccggatttaggtccatggcgggtgtgtatgttttaataggggtggtctctggcgcggcaggatgatggtcgaggacgtccaccagggccttgcagatgctcttgcctagatacaggatgtcgtccatgctgaggggaggtggggtgtctgctcccccctgcggaagccgcctgggtgcggggatgaagacaggtggtgggcgggcgtctcgccggactatggcctcggcacgctcggcgtcgatggcgggtggctggaacaggcgggcgaatgtgtaatcccggaaccggtaggcgacgctgcgcctgagggcgcccgtcaggctgtatcccagctccagggcgtgctccacccgctcgttgagctcctcgagatccggacgcaggggctcgctggtgtgggcccagagggggtgatccgcgatgccccggctctccctgagggccggcaccaggaggcgccttctgagggtggccgtgtcggccgtggccagggcccacctggcggcggcgtcccggcacacatcctggatgccctccacgacgctctttagcgtctggaggtccgtggagtagtggcggggggaggatgaaacgctcttttccttcaccgctaccaccgcctcctcctcctcttccgtcgccagagggatctgcaccctcccggtctctgcgtcgtacaggagcgggcgggagcacagcctccaagctgcccccgtcaagcgcgagatgtcctccgagagggtctcacccgagaccagaaagcggcgggtggccaggcccaacgactccgccgtcgtgctgtatctcagggtgaagaggagtgaaaagagggaggtgggccaggcaagcggtggtgcttccgccgcccgctctgaagctgagatagtctcggagatgatgcctgagacctctcggacggcgtccatgatcctaaggactgcgtcgtgggacgacagcccccaggggcccccgccctcttcgtcttctgcaccctcggctcctgcgtccccggccttgccttccccctctaagttgagggggcgcagtccgaccgcctggggggactccccaggcatcggaggggccccgtcatagatctcccagacggtggcgtatatgagctcgagaggacggcgggcccgggtcagctcgggggaagggagggccaggtcgctgccgaaggagaccagccagcgcagggcggccagagagcgggttttgggcagctcgttggagaggacccggcgaagggcgggccagatttggaactcgatgaaggcggccgggaagaaggggctgtggacataggccggatccgcgcgcgccgtttggccggccctcagggaccggcagtatgcctcgacgtctgtccgcggggccgccgccaccgctgccgtccactgccttcttccctgctcgccggggagtagggggggcttacaggggagggccggagccggggccggggcctgccacaggcggctgtagcggacccatagcagagacctgaggagttcggatgaaaggtcccccgccacctgctcatactcggccgcgggaggggggacgatgaagatgcgcagaggggttacggcgtcccaagggtccgccgccgcccccacacccacagccgtcgcggcgggggcggcggcgggcgtagaggggccgctggtgcgccgggctcgtctgtccacggcctcggcctccgcccgcaggtaggccgcccgggccacacgggcgaagcggctcgtggggctcgcggtgggcagcagtcggaaaaagtgcagggcaaagcccgatagactctctaggagggcggcggtggcctcgagccacctccaccgcgagcgggacacccggggcacagaggccagcatcatggcgtagtcccccgccacggtctcgttgagcccggccgagagcagaaccgtggccacctgctcgatggcggctggagagaaggatgcccggctccccgccgcctcctgcacacgagcggccagggcctccatctctgccgccatcccggccaggaaggcctcgatgaccgagtctgggacgccgtaagtctggtcccagagcagggcctcgtacacatagtcgtaaaagagggcccctgagggctccaaaagccggagccgggcggcgtcaaaggccaggacgggcacagccgcgacggggggcgtttgtcccccgctggcctccgcgtacacgcccaggatctctaccgcccgccgccgggccaggggcagcgaggccaccacgctggaaagtgactcggggcggtgaaagagaccaccaccgctttcttcaccctctcccccgccggccccgcccccactgtgctccaccagctccacggccatggccttgatgtccgcggccgtgggctgaccctgccctgcagccgcccaggggtagcggttggtctccgcgtatacggtgaccagccatctccccagcgtcgttttcgccgcgttaaaagcgtagaatgacagcccctcccgcgggaaggcgtcccaccgggccagataagtgtcggccaccagctcttccacgaaggcaaaggtggccgttgggccagagaccgcgagcacctccccgctgccctcttcgatgatgcgccggtacgcggccgccagggcccgggtctctgcgatgagccgagagccgtccagcggatcgtcggtggccggagaggctgtcgtggggggcagtgaggatgccagcacgtccagggccgcctccagatggccgaggccgaagctgcgcctggaaaaggaggccgcccggagtaggtagtaggcgtggtggcggaggaccgccgccgggtaagcgtggccgctcatgagggtgagagtatttaaaaaatcgcgcaccagcaccggctgggccaaatcccccagtccaaagatccccagctccagaggcatcagcgcgcgcaggcgggcagcggggtcgtccccagacagcagcaactgacgcgtcacgcgggcgagccccccgtccacctctgccaggggtggctgggcgtctgcccctccgctaccgccgctgctgtcactctccatagcggacgccatgaaggtccaggggtccgtcgatcgccgccgtctgcaacgccgaatcgcggggctgctgccccctccggcccggcgtctaaatatttcccgggggtccgaattcacgcgggacgttcgtgggctggttgaggaacacgcgcaggcctcctcgctgagtgcggcggccgtctggcgcgcagggctgctggccccgggggaggtggcggtcgccgggggtggcagtggaggggggagcttcagctggtctgggtggcggccgccagtctttggggactttctgatacacgccagctccttcaacaacgccgaggccactggaacgccccttttccaattcaagcagagtgacccgttctcgggcgtcgacgcggtattcactcctctctccctgtttatcctaatgaatcacggccggggtgtagccgcccgggtcgaggcaggtgggggcctgacgcggatggccaacctgctgtacgacagccccgcaaccctggctgacctggtcccggactttgggcggctggtggccgaccgccgcttccacaacttcatcacccctgtgggccccctggtggagaatataaagagcacctatctgaataaaatcaccacggtggtccacgggcctgtggtcagcaaggccatccctcgcagcaccgtcaaggtgacggtgccccaggaggcctttgtggatctggacgcgtggctctccggcggcgccgggggtggcggtggagtatgcttcgtcggggggctgggcctgcagccgtgccccgccgatgcgcgcctctatgtcgctctgacctatgaggaagccgggccgcggtttacgtttttccagtcgtcccgcggccactgtcagatcatgaatatcttaagaatttattactcaccatccatcatgcaccgctatgctgtggtccagcccctacatatagaggagctaaccttcggggcggttgcctgtctggggacatttagtgctactgacggttggaggaggtctgccttcaattaccgtggctctagcctccccgtggtggagattgacagcttttattccaacgtctctgactgggaggtgattctctagacttaacgggaggaaacaggaggaggagggggacaagagcacaaaagtggttcagtggacacccaccacacagcatggcaacgaccagtcatgtcgagcatgagctcctctccaaattgattgatgagttaaaggtcaaggccaactcagaccccgaggctgatgtcctggccgggcgcctgctccaccgccttaaggccgagtcagttacacacacagtagccgaatatctggaggtcttctctgacaaattctacgatgaggaattcttccagatgcaccgggatgagctggagacccgagtctctgctttcgcgcagagcccggcctacgagcgcatcgtctccagcggctacctgtcggccctgcgctactatgacacctatctgtatgtggggcgcagcgggaagcaggagagtgtgcagcacttttacatgcggttagccggcttctgtgcctcaaccacctgcctctacgcgggtctcagggcagccctgcagcgggccaggccggagattgagagtgacatggaggtgtttgattactactttgagcacctaacctcccagacggtgtgctgctccacgccctttatgcgctttgccggggtggaaaactccactctggccagctgcatcctcaccacccccgacctcagctccgagtgggacgtgacccaggccctctataggcacctggggcgctacctctttcagcgagccggggtgggtgtaggggtgacgggggctggccaggatgggaaacacatcagcctcctgatgaggatgatcaacagccacgtggagtaccacaactatggctgcaagaggccggtcagtgtggcggcctacatggagccctggcacagccagattttcaagtttttggaaacgaagctgccggagaaccacgagaggtgcccgggcatctttacggggctctttgtccccgagctcttcttcaagctttttagggacacgccctggtcggactggtacctgtttgaccccaaggacgccggggacctggagaggctctacggggaggagtttgagcgcgagtactatcggctggtgacagcgggcaagttttgtgggcgggtctccatcaagtccctgatgttctctatcgtcaactgcgccgtcaaggccggcagccccttcatccttttgaaggaggcctgcaacgcccacttttggcgcgacctgcagggcgaggccatgaacgccgccaacctgtgcgccgaggtgctgcagccctcgaggaagtctgtggccacctgcaatctggccaacatctgcctcccgcgctgcctggtgaatgcgcctctggcggtgcgggcacagcgggccgacacgcagggggatgaactcctgctggccctccctcgactctcagtcaccctacctggagagggggcagtcggtgatggattctcgctagcccgcctcagagatgccacccagtgtgccacctttgtggtggcctgctccattcttcagggatcccccacttatgattccagggatatggcctccatgggcctcggggtgcagggcctggccgatgtctttgcggacctgggctggcagtacactgaccctccctctcgctcgttaaacaaggaaatattcgaacatatgtactttacggccctctgcaccagtagtctgattggacttcacaccaggaagatttttccgggtttcaaacagagcaagtatgccggggggtggtttcactggcacgattgggcaggaacagacctttctattcccagggaaatttggtctcgcctctctgaacgcattgtgagggatgggcttttcaattcacagtttatcgccctgatgcccacctcaggctgtgcccaggtgacgggctgttcggacgccttctaccccttctatgccaatgcgtccaccaaggtcaccaacaaggaggaggcccttaggccaaaccggtctttttggcgtcatgtgcgtctggatgacagggaagctttgaatcttgtcgggggccgtgtctcctgcctcccggaggctctgcggcagcgctacctgcgtttccaaacggcctttgattacaaccaggaggacctgattcagatgtcccgggacagggccccctttgtggaccagagccaatctcacagcctgtttttgcgtgaggaagatgccgcgcgggccagcacgctagccaacctactggtgcgcagctacgagctgggcctgaagactatcatgtactattgtcgcattgagaaggccgccgatctgggggtgatggagtgtaaggccagcgcggctctgtcggtgccgcgggaggaacagaatgagcggagtcccgctgagcagatgccgcctcgtcccatggaaccggcgcaggttgcggggccggttgacatcatgagcaagggcccaggggagggaccaggtgggtggtgtgtgcccgggggattggaagtgtgctataagtaccgtcagctcttctcagaggatgatctgttggagactgacggttttactgaacgagcctgtgaatcttgccaataaacgtttattgccatgtccaagttgttgtacgtgcgtgatcatgagggctttgcctgcctaacggtcgaaacccaccgcaaccgctggttcgcggctcacattgtcctcaccaaggactgcgggtgtctcaagctactcaatgagagggacttggagttttacaagttcctctttacgttcctggccatggccgagaagcttgtgaactttaacattgatgaactggtcaccagcttcgagagccacgacattgatcactactacaccgagcagaaggccatggagaacgtccacggggagacttatgctaacattttaaacatgctctttgatggggacagggcggcgatgaacgcctacgcagaggccatcatggccgacgaggccctgcaagccaagatttcctggctccgtgacaaggtggcggccgccgtcaccctgccggagaagattcttgtgttcctgctgattgaaggcatcttcttcattagctccttctacagcatagccctgctgcgggtccggggcctaatgcctggcatctgcctggccaataactacataagtagggatgagctgctccacacccgcgctgcctccctgttatacaatagcatgacagccaaggctgaccgaccaagggccacctggatccaggagctgtttcgcactgcggtggaggtagagactgccttcatcgaggctcgtggagagggggttaccttggtggatgtgcgagccataaagcagtttctggaggccacggccgatcgcatcctgggtgacattggtcaggctcccttgtatggcacaccaccccccaaggactgcccgctcacctacatgactagcatcaagcaaactaatttctttgagcaagagagttccgattacaccatgctggtggtagatgacctttgagtcagggtggctacttgctcaggtttctgggcataaattctcctgcctgcctctgctctggtacgttggcttctgctgctgcttgtgatcatggaaaccactcagactctccgctttaagaccaaggccctagccgtcctgtccaagtgctatgaccatgcccagactcatctcaagggaggagtgctgcaggtaaaccttctgtctgtaaactatggaggcccccggctggccgccgtggccaacgcaggcacggccgggctaatcagcttcgaggtctcccctgacgctgtggccgagtggcagaatcaccagagcccagaggaggccccggccgccgtgtcatttagaaaccttgcctacgggcgcacctgtgtcctgggcaaggagctgtttggctcggctgtggagcaggcttccctgcaattttacaagcggccacaagggggttcccggcctgaatttgttaagctcactatggaatatgatgataaggtgtccaagagccaccacacctgcgccctgatgccctatatgcccccggccagcgacaggctgaggaacgagcagatgattgggcaggtgctgttgatgcccaagacggcttcctcgttgcagaagtgggcacgccagcaaggctcaggcggcgttaaggtgacactcaatccggatctctacgtcaccacgtatacttctggggaggcctgcctcaccctagactacaagcctctgagtgtggggccatacgaggccttcactggccctgtggccaaggctcaggacgtgggggccgttgaggcccacgttgtctgctcggtagcagcggactcgctggcggcggcgcttagcctctgccgcattccggccgttagcgtgccaatcttgaggttttacaggtctggcatcatagctgtggtggccggcctgctgacgtcagcgggggacctgccgttggatcttagtgttattttatttaaccacgcctccgaagaggcggccgccagtacggcctctgagccagaagataaaagtccccgggtgcaaccactgggcacaggactccaacaacgccccagacatacggtcagtccatctccttcacctccgccacctcctaggacccctacttgggagagtccggcaaggccagagacaccctcgcctgccattcccagccactccagcaacaccgcactggagaggcctctggctgttcagctcgcgaggaaaaggacatcgtcggaggccaggcagaagcagaagcaccccaagaaagtgaagcaggcctttaaccccctcatttaacaccatgttctcgtgcaagcagcacctgtccctgggggcctgtgtcttctgtctcggcctcctggccagcacccccttcatttggtgctttgtctttgccaacctgctctctctggagatcttctcaccgtggcagacacacgtgtacaggcttggattcccgacggcatgcctaatggccgtcctctggacgctggtacccgccaagcacgcggtgagggccgtcactccagccatcatgctgaatattgccagcgccttgatcttcttctccctcagagtctactcgaccagcacgtgggtttctgccccctgtctctttctggccaacctgcctctcttatgcctgtggccccggctggccatcgagattgtttacatctgcccggctatacaccaaaggttctttgaacttgggttgctcttggcctgcaccatctttgccctgtccgtggtctccagggccctggaggtgtcggctgtcttcatgtctccatttttcatctttctggctttgggctctggaagcctggccggtgctcggcgtaaccagatttacacctcgggtctcgagcggagacgcagcattttctgcgcccggggagatcattcggtggcatccctgaaggagaccctccataaatgcccgtgggatctgctggccatctctgccttgaccgttcttgtcgtctgtgtgatgattgtgttgcatgtgcacgcagaggtgttctttggactctctagatacctgcccctctttctctgtggggcgatggcctccggggggctgtacctgggccattccagcatcattgcatgtgtcatggccaccctctgcaccctgacatctgttgtggtatatttcctccatgaaacccttggacccctgggcaagaccgtgctgtttatctcaatctttgtctattactttagcggggtagcggccctgagcgcagctatgcgctacaagcttaagaagtttgtgaacggacccctggtccatctccgtgtggtatacatgtgctgttttgtctttactttttgtgaatatctgttggtgacattcattaaatcctaacgaccggagtcctgtctctttgtgttcttgggggacttgagttagctgtctttcctcttattacattgggctaacgggaggaaatgaacccaggggtggcagtggatggggtcatttatgggcaaaactcacaggacatgtttggggagttagcattggcgtcgggaaacacagctctggcagttataaccgcaccagctaacaggacatgtttgggggagttggcattggcgtcaggagacacggctctgtcagttatcaccgtaccatgagtgccatgtgtgtccagtgcctaatcaccgttcctcattttgtgtgcctcctcaaatgttccagaagtcggccacaggggaggtggctgaattagggccttttccctcattcccccatgagacccacgtggcaggcctaggggctacattcgcctcccacgtttcccttcgcgtgaggcatccgatatgactgaattttcgcagtctcttttccctcttcccttgttattcccatagaattacagtgaggttacacaggtggagattcagtttaaccatttattgatttaatccaggaacaaaaaacagtcctagtgacccagtgcccggagagagaatggccctgacaagtcggctgcatgatgcacttcggcagtcacgtgtgtgagtctccacggcctctgtcaaaagggagcttagcgtgccagggttgtaattcttgatgtagtggcccaggaattcaacttcatcgtgtctccgtctgcagttggcgttaatgtaggctggggctactgccgcatatgctgccaagagacagaggggctgcttcacatatgagctgctcagggtctccaccaccttgttttgacgggccgtggcacaggtgatgtagaagagttgcttcacaaagttgtagtctcgcgtgttaggaaggaagcagggtgccagctctttgagcttggtcaggatcaccttgctaagactcatggcgcaggccaggaggatgtcttccgcgggagctaggggcaggtcgccgtggtaggtgatctcctggagccaaaagatggtctcttctagcatggccaccagggtgcagagccccgcgttctggatcgcctgcatgcgtgcatccagccatgtgtccttgttggttgacttggtgaaaaactcacgtagtgtcttgtagctcctgcgcagctcgtgtctgggttgcactttctgccaggctccaatctctggatgggcggccaccgccagcatcgactgtaggaacgggtcttggatgggctctagggtcagagaggccagggggctgggcaaggtgacaaatgtaatcttggagacaggcttaaccagactcatgtcaaaccacggtttgttcggcaggggcctctggctgcgttcttgcctcgcctgcttccttgtgctcctgccggcccctcgagattctgaccggggacctctggttgctctgttgcttcggggagctcttggagacctcggtgctctaggcaccctgggggcccttggggctctgggcgctcttgctcccgggggcaggtgtcggcgcttgccataactttcatcggtgcagccatggacctctccgcgtcgccttttgtggcctctggtgtaagaggagttgccagtctcctccttctcgtcctcgtccctgcacaggggtgagcgatgcaatgtgactgtcttgtcctgtaggtcccacttctttctgggaatcacaaacgatgccgaggtaggggttatgaccacgctggagggccgtgcaggtatggcgtgggccggagttggatcttcatcctcctcctctgaggatgaaatctctccatctgtggagtgttcttcgctgccctccatagggtccagatcgcagtctgtgttggtgtctgagaccgcttcgagttccagaatgtggctctctgcagaggggagacaaaaggtggagactgccttgagcacctctgtctcaggcaccggatgcccccggctccacggccccggccactggccggtgtagcttcttacctgcgggatcctcgttggaggaaatgctgctagttcgggagagtctctgagaaggaaccatcttgtctgtctctacgacgggctagctgggatgtagtgctgtcttgactggcctcagccctatttatgattctggaggcgggcacgctgatggagaaatgggcggtcggttgattggccccacagcgaccggcgaagcactgactcatgaaggtgaccgtgatggcctgtgatgtgtagtagagtaccagaaacaccctcacattcttggagctggccctgtgggtatgcctcaggcacgcaaagttcctgccccgggcatggcacacctgaactaagtttggcccggtttgctcaaacgtgacatggagaaactgggggaatttgtcttctggcacagctgttgccagggtgctcatgagcgagggccagatgcaggagctgacccaggcgacgagatccaggcccagatgtccctctatcatggcgcagacattctccacggtggggggcagggtctcgcgggtcctctggattagatagtcacgcccatcatccgcgatgtggtagcagaaggttttgggggccggccagcccacgtgcagtgagtgatgtaagaggttttgaatgttgagggcattcttaacatagctgtgcttgtcttcctcttccggatgacagacaaagaggcgcagctgccggctaagaccaccgcccctgtccaccttgtaggtatgcggcagccggatgcaccgcccggcgtgatacacgccgctgtcaaaaagcggggccccaatctctttgatcttgtgacgcatgcggcgcaggcaggccgttaggcccatgagcttctgcagcacagacacaaacccttgtactgcgcttgttcccacaatagcatggcctctaggtaggggggtgatgacgcgaaagcccagttttcccgtgcatatgcaaaaggggagcacatcttccatattatccgggtcggcgggtggacaagctgatttgaaaaaatagactgggtgggccctggacactggacccaggcggcgcatgaggcgcagtacctcacgccgcacggtccggcacaggtcatagatttcctccagcgaccagggggcccccttgatctttagatccaggtccaagaccaggttgcagaccggaagccggggattaaagtattcatgccgggagacaaagagctgctcgctcaggctgttctgtgaatagtacactggggtgtaggagagggccctggtgagacacgtgtctgggaggcggcagttggtcggggtggagacgacctccgccaggtgggatgagaaggggtcagcggctgtcattacaaagtagtgcctgtctgcaaaatggcagaggaagaccggtagccgctgcacccttcgaaggacggtgggtgggaggaattgttccttgggattccactggccccggcaggtggcctggccggccaagcatagaaacccttgaagcgtgggggggtatgtgggaccctcatccgcgtgccagcgcgcgagctccaccagctcccgggccacgtccacactgagcccggcccaggcccgcatgagtccgtcatcggggtcggggtcccacgtgtatggggccgggggctccatgcggattttcagctgctggacacgcacatgctcagccaggtaagtctcccgggtgaagtaggtgcgcatgtgctccgcaaagcccctgtccaggagcgaggggagcacgacgccccccgaaggcagacacccaatttctcccatgctcgttaactgagagtatcgcttaaaggttccctcgttgaagcactgtgcgtgggccaaatagacgtagcgcacgagatcggccgaggccaggggaaggcgccccctgtaggcgtctatcgtccttgccacagcgcggatctctcgcgagtcccgccgcagtttctcgtgtgcaaagtgggcaaaagcctcggtctgctccgcccatgccgaggagccaaagacctcccccagctcggccagggacgtgacggcggccaggctctgaccagactcggaagtaaatagctccgtgaggtgcgccagggtctcaatcgtacaaggaatgccccaaaaatagtaagcagccgtgactagcacgaactgggcctcgtgggagccaaaggtgctaatgaaccacctggccgagatgttaacgcggtagatgcggcgcagacagcccacgatcttgggacgcagccacgccacgcggcctctggcatccccctgtggctgtttcttagcgctcagtgtgagcagttccacgaggggcgtgagcgagcgcagggcccccgcgcgatctaggtaggtggatagacggtccgcggtgagcggcgtgaggccgcgcaggaaggggaaggcctcctccgccggcaggtgcagcgtcagaaccaggccgcagcggctctgtgaggtcagccgcttcttgggcaggtgaagctgcagttccacgagagaacccgccacgtggtggaggggcgaggcgttgtggcacaaacaaaacaggcggaagccctcgtcaggccgcgagaggatggcatcgaggatggcctccgcaatgtcagtgtttgaggccacaagggccttgatgacgacgggggcggacattatttaagaccgggaggccccaacggcgggctaaacagaacgatggccttctatctcccagactggtcgtgctgcgggctctggctctttggccggcccaggaatagatacagccagctccctgaggagccggagacctttgagtgcccggaccgctggcgagccgagatagatctgggcctgccccctggtgtgcaggtgggagatttgctaagaaatgagcagacgatgggctcactgagacaggtttatttgctcgctgttcaagccaatagcatcacggatcacctgaagcgctttgacgccgtccgcgtccctgagagctgtcgtggggtggtggaggcccaggtggccaagcttgaggccgtgcgctcagtcatctggaataccatgatctctctggctgtaagcggcatcgagatggacgagaatgggctcaaggccctgctggacaaacaggctggcgacagcctggccctgatggagatggagaaggtggccacggcgctcaagatggacgagaccggtgcctgggcgcaagagatctcggccgttgtctcatcggtgaccgccccctcagcctcggcccctttcatcaactccgcctttgagcccgaggtgcccacccccgtccttgcaccgcctcccgtggtgcggcagccggagcactctgggcccacggagctcgcgttaacgtagcaaccagactccacaccaaataaacattttattggtaaaacaagggatatgaaggtgtcattgacccgaggatccaaaccccctcccctgtctcccctcgagcgcctcgctcagcccactatcacccatggccaggctcggcacctcctcgaaggtgcagctggcccacctaaagagagatctggggccaaggacccccgcgtcactgtgggggctgtagaaggaggtgaggtggtgcttgtgaaggtaaacaagctgacagaagcgccggtacttgttaaggaacacggtctggtcactaaagttggtcaggctgacgtccaccccaccccggcgccacctgcagggcttcactagaataccctgcatggccaggcccgacctgccaaagattgtcggcctgtggtgagggatagaaggggggggcacggtgagtgtcactgagacggtctgatgggggaagagggccaggtcctttggcaaagagacgtccaggcccacgtccccggggtactgggggtggttgatgggacccttgtcctcctccatctggggggtggcatatctgaaggcagccaggtggattttgagctccgatggacgcagcgtggagttgtagcgccgctgattctggaggattagccggagttcccccgtgtagccgggatcgatgatgccaacatgagacgtgaccggacgggaggtgctgccccacagcatgagcccatgaccctcgggtgggcgggcatagaggcctaggtccacagttgtggtcttcatcgggcgcagcaggatggtggtcttgttgaccaaggtgagccgccctacactagcctgctggagcaacagcttgtcattctggaaggcgtagcgtatgtgtggacaggcctccatggtgatgatctaacagacagggacggcggcgctatatataagagcccaagacccggctctctttactgcgaaatggggaaggtcctaagaaagccgtttgcaaaggctgtgccactgctcttcctcgccgccacctggcttctgaccggggtgctgccggccggcgcttccagtcccacaaacgcggcggcggcttccctgactgaagcccaggaccagttctactcctacacatgtaatgcggacacattctcgccttctttgaccagctttgcctccatctgggcacttctgacgcttgtcttagtcattatagcctcagccatctacctgatgtacgtctgctttaacaagtttgtgaacacgctgctgacggattagatggggatatttaaaaggggcagcaatctcggctgtttgtacttcttctctgctcgttaaaccaatagcatgtcagctccacgcaaagtcagattgccttctgttaaggctgttgacatgagcatggaagacatggccgcccgcctggctcgcctggagtctgagaataaggctctgaagcaacaggtcctcagagggggtgcctgtgcctcgtctacctctgttccttctgctccagtgcctccgcctgagccgcttacagctcgacagcgagaggtaatgattacgcaggccacgggccgtttggcgtctcaggctatgaagaagattgaagacaaggttcggaaatctgttgacggtgtaactacccgcaatgaaatggaaaatatattgcaaaatctgaccctccgcattcaagtatctatgttgggtgcaaaaggccaacccagccctggtgagggaacacgaccacgagaatcaaacgaccccaacgccacccgacgtgcccgctcccgctcccggggacgtgaagcaaagaaagtgcaaatttctgattaataaatttttattgactttatacataggtctcggcgtcatcatatggtggggtggtgtaggtatgggatgtagacaagttacgcctaaaggcgcagtccgccatgaccagcagcagcagaagggtcagcacagccagagaggcccactgcagtactagcatggagaggtttgagaatctgggctgggacgttggcgggactggcacggtggcttgggctgtggtaaccggtgggctcgtaaaagtccagcggggccgcagtttgctagaagtgctgggaggtagataggtggtcgcattgtatctcggtcttggcgtagttgaatcaccgccgtaatctgtggtgggctctgtacttgtccgggctccatgtcctgtggtgtgctttccaccggtggtagaattggcctttccacctgttgaggtgaccgtgggaaccgccgtcttttggccactgggggcctggggcgacgttgcattttgggggggcgtgcctttggtgacattaacctcccccggttttgtggatgtggaactgtttccagggcctgacgcttggctggtggtgcctgggcggggtgctggcgaactggtggacacatgatgtgtgctgatagaggctggtgtcacctgtgttatattttcaccacctgttgggtgagcggaggttagtaaaggcatatgtgacgttgaattgtcactggtggaggggctgagtgtctctgggtttgaactgggtctcagtgacatggaagaggttgaacttgaagttatgttatgttggcctgtggtaacagcactggttgcattttttggttggctggtaactactggggtgggacttgttcctcctaaggtgtggttggtggcatttgcctgtggacttgtttctcccacagtagggccggtggcatttggggttggggtagtcactgctgaggtggggcttgtttttcccaaggtggggctggtggcatttggggttggggtagtcactgctgaggtggggcttgtttttcccaaggtggggctggtggcatttggggttggggtagtcactgctgaggtaggacttgtttttcccaaggtggggctggtggcatttggggttggggtagtcactgctggggtggggctggtggcatttggggttggggtagtcactgctggggtggggctggtggcatttggggttggggtagtcactggtgaggtggagctggtcatgtcgggggccttactttctgtgccgttgtcccatggagatggacttggtgtcaccggtgatgcgcctgacgttgtgccggctggtgttgggctggtgacatccgcggtggatacagtggggcctgtgcttgcaggtgcggtgaggttggtaggcacgtgagtagagctgggtagacctgtcgttgtattgggatcagcaaatccagttgtattcaaggtaggggaggtggtggtgctctcgggtgccttggagaatataaccttgtgggttgttgtggtggcattggtagccgttcgtgtgataatgagtgtcttgggggccgtgccaagacccgagacagtaatgtcaaatgtccgattgctcgcaaatgcaccagaaatattttcacaacccgaaggtgtccccgaggtgagagtccatttgcacttaaagtcagtttcagtgttgtttggccaggcccaaaaggcagtcactgtaacatttggcgagtttgcgtcctcagaagtgaccattggcactgaataggtagcattgtcacccacatatgtgatgtctgtggtgtttgtcggcatgtcctgtgaagctggaatctcatcagagaacacaatgttggactgaatgcagtaatctcccccgctcgccttcggtccattcccagagtaaaacacgtacaggatactgttattgccaagaaatcgtgacactggacgtggtgtcagacgcaggctgtatgcataccctgtaccaggtattggggtggccacgggactcgttgatgtgagaattccgccgctgggaacatggctctcgtatccactgcaggtgatgttaaatttgttgtctccgggcagaacttgtgaaatttcgccatcctccataatacactcaatatctatctcattaccgagcatttctgtttttacgctgaaattcgagtcttgagctgacgttggcaaacttaagggtagcgtgacatccagcccctgtgccctcactactgccgttatattggtagaattacagttatcccactttatgtatggcactgtttctggtatcaggtacacggggttttgcatttctgcatggtggcaccacatggttccaaacacatcttgaaagtagacatctacagattccaggcttacttgttgctcctctccggtggtgacgttaattggaagcttcttagaccgcatagttagagccaattctcctgcaccaaggagctccagtagaaagagattggtggcattttctgagccaccaaatgcacctcgaggttggtagacagccttcgtatggggtgtcagctggccaaagtcaagatcaagttgatgctttttgcccccgacatcgaaattgatagttacattgacatctgccgtgcaaacattgcatgtggggtaaaatgggaattccggaatctcaacattgaaaaaaccaggatcttcacccgtgagatggatcaggctctggatggtgtactgacacacaagcaaggctgcctccattgtctcggcaccgatttctaggcagcatcctctttaataggtacaaggggggtgcggtgttggtgagtcacacttttgttgcagacaaaatggacaaggacaggccgggtcccccggccctggatgacaacatggaagaagaagtcccatctacctcggttgtgcaggaacaggtatcggcgggagattgggaaaatgtcctcatagagttatcagatagcagctcagaaaaggaagcagaagatgcccacctggagccggcccagaagggtacgaagagaaagcgggtcgatcatgatgccggtgggtcagctccagcacgacccatgctcccaccccagccggatctccctgggcgagaagccattctccgcaggtttccactagatctaagaacacttcttcaagcgattggagccgcggctacggtgagcatccctatggcctaagtgtgtgatgtgtgtttttacccatcacacaacaacaaggtaagtaatttgttgccgttggtttcagcgcatcgacacacgagccatagaccagtttttcggatcccagatttcaaataccgagatgtacataatgtatgccatggccattcgacaggccattagagatcgtcggagaaatccagcttctcgtagagatcaggccaaatggagactgcaaaccctggccgccggatggcctatgggttaccaggcatacagcagctggatgtacagctacaccgatcaccagacgactcccacattcgtacatctccaggcgacacttgggtgcacaggtggccgtaggtgtcacgtgaccttttccgccggcacctttaagctgccgcgatgtacccccggggatcgccagtggttgtatgttcagagctccgtgggtaacattgtacagagctgtaatccccgctacagtattttctttgactatatggctatacacaggagcctcacgaaaatctgggaggaagttttaacacctgaccagcgtgtttcatttatggaattcctaggatttttgcagagaacggatttgtcctatatcaagagctttgtcagcgatgccctgggcaccactagtatccaaacaccgtggatcgatgacaatcctagcacggagacggcacaggcttggaatgccggctttctccggggtcgtgcgtatgggatagacttgcttagaactgaaggggaacatgtcgaaggtgctaccggtgaaacgcgagaagaaagtgaggacacggagagcgatggagatgatgaagatcttccttgtatagtgtccagaggtggacctaaggtcaaacgaccccctatatttataagacgtctgcacaggttgctgctgatgagagcgggcaaacgaacagaacagggcaaggaggtactggaaaaggcccgtgggagcacttatggcacacctaggccgcctgttccgaaaccaagaccagaggtcccacaaagcgacgagacagctaccagtcacgggtcggcgcaagtcccagaacccccaaccattcacctagcagctcagggaatggcatacccattacatgaacaacacggcatggccccgtgtccggtagcacaggccccacctacgcccttgccccctgtatctccaggggatcaactcccaggtgtttttagcgacgggcgagtggcgtgtgcaccagtacccgccccggctgggcctattgtccggccctgggagccatccctgacacaggctgcggggcaggcctttgcacccgttagaccacaacacatgccagtagaacccgtccctgtcccgacagtggcacttgagcgaccagtttaccccaagccagttcgtccggcacctcctaagattgctatgcagggccccggggaaacttctggcattagacgcgcgcgggagcgttggaggcccgcaccttggacgccaaatccaccccgttctcccagtcagatgtccgtgcgtgaccgtctggctcgtttgcgtgctgaggcacaggtcaaacaggctagtgttgaggtgcagcccccccagttgacccaagtatcccctcagcaaccaatggaggggccgttggtaccagagcagcagatgttccctggtgccccctttagccaggttgctgatgtggtccgggcacctggggtaccggcgatgcagccacagtactttgacctccccttaattcaacccattagccagggggcacccgtggccccgttgagggctagtatgggcccggtacctccggtaccggcaacacagccacagtattttgacatccccttaactgaacccattaaccagggggcatccgcggcccattttctccctcagcaaccgatggaggggccgttggtacctgagcagtggatgttcccaggtgccgccctgagccagagtgttaggccaggggtagcgcagtcacaatattttgacctccccttaactcaacccattaaccatggggcacccgcagcccatttcctccatcagccaccaatggaggggccgtgggtacccgagcagtggatgttccaaggtgccccccctagccaaggcactgacgtggtccaacatcagctggatgctttggggtatacactccatggtcttaaccatcccggggttcccgtgtctcctgccgttaaccaatatcatctcagccaggctgcctttgggttacctattgatgaggatgagagtggcgaggggtccgatacctccgagccgtgtgaagctcttgatttgtcaatccatggcaggccctgccctcaggcccccgagtggcctgttcaagaggagggtggccaggatgccaccgaggttcttgatttgtcaatccatggcaggccccgccctcggacccccgagtggcctgttcaaggggaaggtggccaaaatgtcacaggccctgaaactagaagggtggtggtgtcagctgttgttcacatgtgtcaggatgacgagtttccggatctacaagatcctccagatgaggcctaagcaaaggtgtagaagtgtgtccccctccattccacccactgataatacgcccgacaataaagttgatgatattgaattccacacctgcttgtgtttgtgattttatttcatattccatgagagagacctcgcatatttgcagaagggtcactgaaacatcttatcttaaaacagttacacctgaataatgaagaaagcgtggctcagcagagcacagcaagccgatgccgggggggcatctggctccgaggacccaccagattatggagatcaaggtaatgtgacacaggtgggatctgagcctatttcacctgagattggcccctttgaactctctgcggccagtgaggatgatcctcaatctgggccagtggaagagaatttagatgccgctgcaagagaggaagaggaacctcatgagcaggagcacaatggtggtgacgatcccttggatgtccatactcgccagcctagatttgtggatgtgaacccaacgcaggctccagtgatccaactagtccacgctgtctatgattccatgttggtaagaggcacctagaacatttccagatgtttcgcttggattttttggccagtcttaattgattgtcattggtttcagcaatcggacctccggcccctaggcagtttattccttgagcaaaacctgaacatcgaagaatttatatggatgtgcatgaccgtgcgtcacagatgtcaggccatcagaaaaaaaccattaccaattgttaagcagaggcgttggaagctcctgtcatcttgcagatcctggcgtatgggttaccgcacgcataacctcaaagtaaacagttttgagtcagggggggacaatgtccacccggtccttgtgactgctacgctaggatgtgatgagggcacgcggcatgcaacaacgtacagtgctggcattgtacagataccacgaatatcagaccaaaaccaaaagatcgaaacagccttcctgatggcacgtcgtgctaggtcactttcggcagaaagatatactttgttctttgatttagtatcctccggaaacaccctgtatgctatatggattgggctgggcacgaaaaaccgagtttcatttattgagtttgtaggatggttatgcaagaaggaccacactcatatacgcgaatggttccgccagtgcaccgggagacccaaagcagccaagccatggttaagagcgcatcctgtcgccattccttatgatgatccgttaacaaacgaggagattgatctggcctatgcccgcgggcaggccatgaatattgaggctcctagactgccagatgatcctataattgttgaggatgacgacgaaagtgaggaaattgaagctgaaagcgacgaggaggaagacaagagtggaatggaatctcttaaaaatataccgcaaacactgccgtacaatccaacagtatacggcaggcccgcggtgtttgaccgaaagtcagatgcaaaatcaaccaaaaaatgcagggccatagtaactgactttagtgtaatcaaggccattgaagaggaacacagaaagaagaaggcagccagaacagagcagccaagagccacgcctgaatcccaggcccccacagtggtcctccagcgaccacccacgcagcaagagcctggccccgtcggcccactgagtgtccaggctcggctggagccatggcaacctttgcctgggccccaagtgacagcagttctacttcacgaagaatccatgcagggtgtccaagtacatggttcgatgctagaccttcttgaaaaagacgatgaagtcatggagcagagggttatggcaaccctactgccaccagtaccacaacagccccgggctggcagaagaggcccttgtgtcttcaccggtgacctaggcatagagagtgatgagcccgcttcgacagagccggttcatgatcagctactgcctgccccaggacctgaccctcttgaaatccaaccactaacgtcccccaccacgtctcaacttagcagttcggcaccaagctgcgcacaaactccatggccggtggttcagccaagtcagactccagatgacccaacgaaacagtcccggccaccggaaacagctgccccacgccagtggccaatgcccctgcgacctatccctatgcgccccttgcggatgcagccaatcccatttaatcatccagtgggacccactccccatcagacacctcaagtggaaataacaccatataagcccacttgggctcagatagggcacattccatatcagcctacaccaacgggtcctgctaccatgctgttgcgccagtgggcacccgccaccatgcagacaccaccgagagcgcccactcccatgtcaccacctgaggtgccacccgttccccggcagaggcctcggggggcgcccactcccacgccacctcctcaggtgccgcccgttccccggcagaggcctcggggggcgcccactcccacgccacctcctcaggtgctgcccactcccatgcagctggcactaagggctcctgctggtcagcaggggccgacaaagcaaattttgcgccaattgttaacggggggcgtcaagaaagggagaccatcacttaagttacaggccgcccttgagcgtcaagccgctgcgggctggcagccttcaccagggtccggcaccagtgacaagattgtgcaggcgcctattttctacccacccgttttgcagcccatacaggttatggggcaagggggttccccaacggccatggccgcctcagcggtgacacaggcacccacggaatataccagggaaaggaggggagtggggcctatgcctcccaccgatattccgccgtctaaacgagcgaagatcgaggcctatacagagcccgagatgccgcacgggggggcctcgcactctcccgtcgttatcttggagaatgtcggccaggggcaacagcagactctggagtgcggaggaactgctaaacaggaaagggacatgttggggctgggggacattgcagtttcttccccttcctcttctgaaacatcgaacgatgagtgatttcgcccatgtaacaagaactgggatgaaccctggggcaacagactgcggggaggaggggggcagtgataagtcatgacaattttagatgaggtagaaattttgcatattttcagacccaccatggaatcatttgaaggacagggggactctagacagtcacccgacaatgagcggggagataatgtacagactaccggcgagcatgatcaggaccctgggccggggcctccatccagtggggcttctgagagattggtaccagaagagtcatactcaagagatcagcaaccttgggggcaaagcaggggtgatgaaaacagaggctggatgcagcgcatcaggcgaaggcggagaagacgggctgccttgtccggccatcttttagacacggaagacaatgtgccgccatggttgcctccacacgacatcacaccatataccgcaaggaatatcagggatgctgcctgccgggctgtcaaggtgagtatgcctctaactgggttcatgggggccatctaaggcccacgtgtgacccatgtttccattaattttagcaatcgcacctgcaagcgctatcaaacctgatactcgatagtgggttagacacacaacacatcttgtgcttcgtgatggcagccaggcagcgtcttcaggacattcgacgtggacccttggttgcggagggcggtgtgggttggcgacattggcttctaacatctcccagccaatcctggcccatgggatatcgtacagcaacactacgcacattaactcccgtgcctaacagggttggggctgacagcatcatgttaactgccacatttggatgccaaaatgcggcacgaactctaaacaccttctctgccaccgtgtggacaccaccccatgctggaccaagagagcaagaaagatacgctcgggaagccgaggtacgcttccttcgtggtaaatggcagaggcggtaccgaagaatctatgatttgatagaactgtgtggctctctgcaccacatctggcaaaacttgctccagaccgaggagaaccttttagatttcgtgcgtttcatgggtgtcatgtccagctgcaataatccagctgtgaattactggtttcacaagacaatcggaaactttaagccatattacccgtggaatgcaccacctaatgaaaatccatatcacgcgcggagaggcataaaagaacacgtaatccagaacgcatttcgaaaggcacaaatacagggtttatcaatgttagcaacgggaggtgaacccagaggtgatgctactagtgaaacgagcagtgatgaggacaccggtagacagggttcggacgtggagctagagtcctcggacgatgagctgccatatatcgatcccaatatggagccggttcagcagaggcccgtcatgtttgtgagccgtgtgcctgcaaagaaaccgaggaaactgccttggcccacgcccaagacgcacccagtgaagcgcacaaatgttaagacctctgatagatctgataaggcagaagcacaaagcacccctgaaaggccgggcccttccgaacaatcatcagtgaccgtggagcccgcccacccgaccccggtggagatgccaatggtgattctccatcaaccacctccagtgcccaaaccggttccagtcaagcctacgccaccgccttcccgtaggagaaggggagcgtgtgttgtgtacgacgatgatgtcatagaggtgattgatgttgaaaccaccgaagattcatcgtcagtgtcacagccaaataagccacatcggaaacatcaagacggctttcaacgttcaggccgacgtcaaaaacgagccgcgcctcccaccgtgagtccttcggatactgggcctcctgccgtggggcctcctgccgcggggcctcctgccgcggggcctcctgccgcggggcctcctgccgcggggcctcctgccgcggggcctcctgccgcggggcctcgcatactggcgcctctttccgctgggcctcctgccgcggggcctcacatagtgacgcctccttccgcccggcctcgtataatggcgcctcccgtcgtacgtatgtttatgagggagcgacagctcccccagtccaccggccgtaaacctcagtgcttctgggaaatgcgggctggtcgtgaaattacacaaatgcaacaagaaccaagttcacacctgcagtccgccactcagcctacaacgcctcgcccatcatgggccccatcagtctgcgccctctcggtgatggatgctggtaaggcccagcccatagaaagttcacacttgagttccatgtcgcccacacagccgatatcgcacgaagaacaaccccggtatgaggatcctgacgctcctctggatttaagtttacatccagacgttgctgctcaaccagctccccaggctccataccagggataccaggagccgccggccccccaggctccataccagggataccaggagccgccgcccccccaggctccataccagggataccaggagccgccggcccacgggctccaatcatcttcatatccaggatatgcgggtccctggaccccaaggtctcaacatccatgttataggcacccctgggcaccatggtctcaagatcctgtgcatgggcacacccagggtccatgggatcccagggcaccacatctcccacctcagtgggatggatctgcaggacatggccaggatcaggtctcccagttcccacatctgcaatcggagacaggcccaccacgtcttcaactttcattggtgccactggtctcatcctctgcaccatcatggtcatctccccagccccgagcccccatacgccccattccaacaagattcccccctccccctatgccgttacaagatagcatggccgtggggtgtgactcatcaggtacagcatgcccaagcatgccctttgccagtgattacagtcaaggtgcatttaccccactggacattaatgccaccacgccaaaaaggcctcgagtagaagaaagttctcacggacctgcccggtgttcccaagctactgctgaagcacaggagattctcagtgacaattctgagatctccgtgttcccaaaggacgcgaagcagactgactacgatgcatccactgaaagtgagctagattaaggggatccaaggtgacccctgttagctatttgatctttgactgacacataaacatggtttaaggaatgaacactcatggtgtgagactggaactgtactaaatttgctgacatatgtacaatgagagccaaaaatttgataaaccttaaaagtccccccatctaatgatgtccagttcccttctcccaccctgtacaccccgacccaaagggactcaatggcattcagatttctagttaccacaggtagaatatcgggcgttggcccataaaaataagtgcatggatatagctctgcacaggcttggaaacacccattccaggtgtgcttctttttggtgaaataaaaacagcatcctttatatgaaaatgtgtattctctggtgttgcagtatgtacagttagctttggtatagttttggggtacctgaaatgtgtgcagggtgggtgtccaatgtggcagttttacctctttgtccccatactcctgctcggccgtcttgttaaagttaaccggcggtggaggatccaccggccagacctctacatttggtttgggtacccaggtgatggccgcggctgccacccgccctcctcctcttaccctgggtggcaaaaagtatgccaggagtagaacaataacaagtgcgatggcggtaaacaatggcaccctcacctgcttaaatgaaaccatggcaaccacttcaaagagagccgacaggaagatatttattaatattccattagtaaacgaggcgtgaagcaggcgtggtttcaataacgggagttagaaatttaagagatcctcgtgtaaaacatctggtgtccgggggataatggagtcaacatccaggcttgggcacatctgcttcaacaggaggcgcagcctgtcattttcagatgatttggcagcagccacctgcggacaaaaatcaggcgtttagatggggcatttatgtttgggacgctagccgcctgggcattcgtgttagtatatactgacctcacggtagtgctgcagcagttgcttaaacttggcccggcattttctggaagccacccgattcttgtatcgctttatttctagttcagaatcgcattcctccagctgcgagcaagggaatgcgttactacaagtggtgcctagtcagttgaaacaagccccaccatccgctgccgcccctccatgagccccaccgtccgctgccgcccctccttgagcccctccttaccgattctggctgttgtggtttccgtgtgcgtcgtgccggggcagccactggtgcaggctgtggaacaccaatgtctgctagctgttgtccttggttagccccggggcaagcaaacaccactgctgctgctgtttgaacagtagaattgtctccaggttgaggtgcttctcccccggcttggttagtctgttgattctgggttatgtcggagactgggaacagctgaggtgctgcataagcttgataagcattctcaggagcaggctgaggggcagaaaaccacgacccagtcggagcggttgaaacatgataggcagttagctggccttgtggcagaggctctggcagcaccggccacagcacacaaggcaaaggagcttgcgatggccctcccaggtcctgatagactctggtagcttggtcaaaagcttgtacaaaaggcacctggtatgggtcaggtgtaaattttacatcttcagaagtcgagtttgggtccatcatcttcagcaaagatagcaaaggtggccggcaaggtgcaatgtttagtgagttacctgtctaacatctcccctttaaagccaaggcaccagcctcctctgtgatgtcatggtttgggacgtgctaaatttaggtgtgtctatgaggtacattagcaatgcctgtggctcatgcatagtttctaaaagaggaggaggcagttttcagaagtgtctaaaataagctggtgtcaaaaatagacagcccagttgaaatatgcatggcatgcagcagacattcatcatttagaaatgtatccaagatttcattaagttcgggggtcaggggggagtccagattcaaatcctctgtcatggactctagtgttgtggtcagttcgtccaaatggccacgagggggcgggtggctcaggtccatctgtccacatatggctgcttcctccttctggggaataacagtgtcagccatctcccttagggccttcacggcctgactggtttcttcatcagggtcctccaacagatgacttgcctcgggggttactgcgggggccgggtcaagtggctggggcaccggggctggcgttagggatccgaccggttcatggacaggtcctgtgggggtgggagccaaagaggcaggcaggggccggttggcccacggggatccgggtggatggaagggcctgatcctctttggctgacacacctctcgcccctcgaacacgtcagatatggcactgcccgcttccggctttggcaggaacataccttcccggctatccctgaggcccttcttccttttaacgggaggaagaaaggtgggctttgaggggtgggggaatatgggtctctcatcgctctcttggtggaccgctgctatccaaggctgttcaggttccgccgcgttggaaggacatggagtttgaccacggttgggcctggatgtccggcgcgactttggggcccgcaggcgcggggcctcggccctggcctcttcccgctcgctctgctcggtgtcactgttgcccgagtcactgctgctggaactgctgtcaccgcagtcggcgctttgggcaccgggcttcaggggcatggtcgggctcgggagactttcgagttcatctgtaaaagcatgaaactgtccggactccgagtagcgggcctcggtgtgagaggcacccccatcattccccatgagctcctcgtccatcctgtcggctccggacacgaggataggagtttccactgccttggacttggttgacagcaggcacgcgggaagcacgccgctcacgtagctcctctgtccggcgtggctggagtaggaggcccggggcagtgtcttaatcagagccctgacatccttaacatcgtccgtcagatggcctgtcttggacgagaccatagtctggaacatctcctcgaggacgggataggtgaacacccacttgcaaaaggccttgaacttggagcttaggaggccttccttctccatcctgttcaggtgttccactacctgcttgccggaggccatgatggccgcgcggtccacgcccagcaccttgctgtaggtgtaggcccgcacccgactgtgttttaggagcttgtacatagcggtgcctatggtggcaggaatcatcacccggttgctgggggcctggatgaagaatctgtcagtgaccactatcaggtggtctaacacgtagcgcatcactatagggcacgcgatggaacatgcgtcgttgccggcattctcagcccgtcttcttaccctgttgtttcggagaatggcccaaaaattgcagatgttgagcgtggccattagcccgccccattctcgcccgtgggccttggcctcatttataaatgccttgcatattttgtaggatctcagagtaatctccacactcccggctgtaaattccttgttgaggacgttgcagtagtcagagaccagagagcccagctgctttttgatttcaggagttagcctcagaaagtcttccaagccatcctttttaggcctcatggctagtagtaacagaggaaatgcccgaccattaaaatctttcctccatgagctttacctgaaacactatcccgaagtgggggatgtggtgcatctactgaacaccatcggggtcgactgcgacctcccacctagccacccactcctgacagcccagagggggctgttcctggcaagagtcttgcaggctgtacagcagcacaagctgctggaagacaccatcgtccccaagatcttaaagaagctggcttatttcttagagctgctaagctactactcccccaaggatgaacagcgtgacatcgccgaggttcttgaccacctcaagacgaatcgggacctggggctggacgacagactctgggccctgattaggaaactgcgccaagacagacaccatgcctctgtaaatgtcctcatgccaggaagcgactacacagccgtgtcgctgcagtactacgacggcatctccataggtatgaggaaggtaatcgcggatgtctgccgcagtggctatgcctccatgccctccatgacggccacgcacaacctctcccaccagctcttgatggcgtccgggcccagtgaggaaccgtgcgcctggcgcgggttctttaaccaggtcctcctctggactgtggccctctgcaagtttcgcagatgcatttactataactacattcagggatctatagccaccatctcccagcttctgcacctcgagatcaaggccctctgcagctggataatatcccaggatggcatgcgcctctttcaacacagcaggcctctcctcaccctctgggagagcgtggccgcaaatcaggaggtcacggatgccattaccctgcctgactgcgctgaatacatagacctactaaagcacacaaaacatgtcttagaaaactgttctgccatgcaatacaaataaatttctcttacctgcgtctgtttgtgtagtgaggtgttgtgtcctgtatggtattctactttaaaaaggccggctgacatggattactggtcttttatgagccattggcatgggcgggacaatcgcaatataaaaccctgaccatcacatggggcattaggcgactctgcatcagcatcgcttaagtatgagtgggcagcagagaggctcggttattttggttcctgaacatctggctggggcattaactaagcttatgagcgattttatcacaggacaagatgtcactctttctggaggaaatattgcagtcaaaattcgcgatgctataaaccagacccccgggggtggtgatgtagctatactttcttccctgtttgctttatggaatgccctcccaacatctggtagacaatcctccagggacgatttaatcccagccgccgtgcaggccttaaccacggcccacaacttatgtctgggtgttattccaggtgagacctcacacaaggacacacccgagtcattgctccgggctatcgtgacgggtctccaaaaattgtgggtggattcgtgcggatgtccagagtgcctacaatgtcttaagggattgaaggcaattaagcccggcctttatgaaatccctaggataataccacacactaagcagtgtagtcctgtcaatctcctgaacatgttggtccacaagcttgtggctttacgtggtcatgtgcagcttgcatacgacgcccgtgtcctgacgcctgactttcacgaaatccctgacctcgatgactccgatgctgttttcgcacgcaccttattggcagccttatttcacctcaatatgttctttattctcaaagattacataacacaagactccatgagcttgaagcaggccctcagtggtcattggatgtctgccacgggcaaccccctgcctgcagcaccggaaaccctgcgagactacttggaagctttccgaaattcggataatcacttttatctcccgacgacagggcctttaaacaccttccaatttcccgaagagcttctggggcgcgttgttgttattgattcctctttgtgtgccgccagtcacgttcaggacgttatcacccatggtgttggggcgggtgttcctcgtcctcggttttcggccctgcctccggccccatcccgcgagccccagcagacatgctctcagttaacgagcagagggaatgaaagctcacggcgaaacttgggccagcccggggggacctcccctgctgttcccccagtttgccccatcgtttccctgacggcctcaggggccaagcaaaaccgcgggggcatgggatccttgcacttagccaagcctgaggaaacctcccccgccgtctccccagtatgccccatcgcttccccagcggcctccaggtccaagcagcactgcggggtcactggatcctcacaggccgcacccagcttttcttccgttgccccagtagcatctctgtctggtgaccttgaagaggaagaggaggggtcccgagaatccccatccctaccgtccagcaaaaagggggacgaggaatttgaggcctggcttgaggctcaggacgcaaatcttgaggatgttcagcgggagttttccgggctgcgagtaattggtgatgaggacgaggatggttcggaggatggggaattttcagacctggatctgtctgacagcgaccatgaaggggatgagggtgggggggctgttggagggggcaggagtctgcactccctgtattcactgagcgtcgtctaataaagatgtctattgatctcttttagtgtgaatcatgtctgacgaggggccaggtacaggacctggaaatggcctaggagagaagggagacacatctggaccagaaggctccggcggcagtggacctcaaagaagagggggtgataaccatggacgaggacggggaagaggacgaggacgaggaggcggaagaccaggagccccgggcggctcaggatcagggccaagacatagagatggtgtccggagaccccaaaaacgtccaagttgcattggctgcaaagggacccacggtggaacaggagcaggagcaggagcgggaggggcaggagcaggaggggcaggagcaggaggaggggcaggagcaggaggaggggcaggaggggcaggaggggcaggaggggcaggagcaggaggaggggcaggagcaggaggaggggcaggaggggcaggaggggcaggagcaggaggaggggcaggagcaggaggaggggcaggaggggcaggagcaggaggaggggcaggaggggcaggaggggcaggagcaggaggaggggcaggagcaggaggaggggcaggaggggcaggagcaggaggaggggcaggaggggcaggaggggcaggagcaggaggaggggcaggagcaggaggggcaggaggggcaggaggggcaggagcaggaggggcaggagcaggaggaggggcaggaggggcaggaggggcaggagcaggaggggcaggagcaggaggggcaggagcaggaggggcaggagcaggaggggcaggaggggcaggagcaggaggggcaggaggggcaggagcaggaggggcaggaggggcaggagcaggaggaggggcaggaggggcaggagcaggaggaggggcaggaggggcaggagcaggaggggcaggaggggcaggagcaggaggggcaggaggggcaggagcaggaggggcaggaggggcaggagcaggaggaggggcaggagcaggaggggcaggagcaggaggtggaggccggggtcgaggaggcagtggaggccggggtcgaggaggtagtggaggccggggtcgaggaggtagtggaggccgccggggtagaggacgtgaaagagccagggggggaagtcgtgaaagagccagggggagaggtcgtggacgtggagaaaagaggcccaggagtcccagtagtcagtcatcatcatccgggtctccaccgcgcaggccccctccaggtagaaggccatttttccaccctgtaggggaagccgattattttgaataccaccaagaaggtggcccagatggtgagcctgacgtgcccccgggagcgatagagcagggccccgcagatgacccaggagaaggcccaagcactggaccccggggtcagggtgatggaggcaggcgcaaaaaaggagggtggtttggaaagcatcgtggtcaaggaggttccaacccgaaatttgagaacattgcagaaggtttaagagctctcctggctaggagtcacgtagaaaggactaccgacgaaggaacttgggtcgccggtgtgttcgtatatggaggtagtaagacctccctttacaacctaaggcgaggaactgcccttgctattccacaatgtcgtcttacaccattgagtcgtctcccctttggaatggcccctggacccggcccacaacctggcccgctaagggagtccattgtctgttatttcatggtctttttacaaactcatatatttgctgaggttttgaaggatgcgattaaggaccttgttatgacaaagcccgctcctacctgcaatatcagggtgactgtgtgcagctttgacgatggagtagatttgcctccctggtttccacctatggtggaaggggctgccgcggagggtgatgacggagatgacggagatgaaggaggtgatggagatgagggtgaggaagggcaggagtgatgtaacttgttaggagacgccctcaatcgtattaaaagccgtgtattcccccgcactaaagaataaatccccagtagacatcatgcgtgctgttggtgtatttctggccatctgtcttgtcaccattttcgtcctcccaacatggggcaattgggcatacccatgttgtcacgtcactcagctccgcgctcaacaccttctcgcgttggaaaacattagcgacatttacctggtgagcaatcagacatgcgacggctttagcctggcctccttaaattcacctaagaatgggagcaaccagctggtcatcagccgctgcgcaaacggactcaacgtggtctccttctttatctccatcctgaagcgaagcagctccgccctcacgggccatctccgtgagttgttaaccaccctggagactctttacggttcattctcagtggaagacctgtttggtgccaacttaaacagatacgcatggcatcgcgggggctagacctctggctggatgagcacgtgtggaagaggaaacaggagattggtgtgaaaggagaaaatctgcttctccccgacttatggctagatttcctacaactcagccccatcttccagcgcaagcttgctgccgttattgcctgtgtccgacgcctgcggactcaggccaccgtctacccagaggaggacatgtgcatggcctgggcccgcttttgcgacccctctgatattaaggtggttattttgggccaggacccctatcacgggggtcaagcaaacggcctggcattcagcgtcgcatacggctttccagttccccccagcctgaggaacatctacgcggagctgcaccggagcctgccggagttttctcccccagatcacggctgtctagacgcgtgggcctcccagggggtgttgctactcaacaccatcctgaccgtgcaaaagggcaagcccggctcgcacgcagacattggctgggcgtggtttactgaccacgtaatttcattgctctctgagcggttaaaagcgtgcgtgtttatgctgtggggtgcgaaggcgggagacaaagcttcactaatcaactccaagaagcatctggttctgacctctcagcatccctctcccctggcccagaacagcacccgaaagagtgcccagcagaagttcctgggcaacaaccactttgtcctcgctaacaactttttgcgtgagaaggggctcggtgagatagattggaggctgtagaggggtcatcactatggccatgtttctgaagtcgcgtggggtccggtcttgcagggaccggcgcctcttgtcggacgaggaggaagagacttcacagagcagcagctacactctggggtctcaggcctcccagtctatccaggaggaggacgtgagtgacactgatgagtctgactactcagatgaagacgaggagattgatttggaggaagagtaccccagtgacgaagacccatctgagggcagtgatagcgacccctcgtggcatccttcagattcagacgagtctgactacagcgagagcgacgaggatgaagcaacccccggctctcaggcctcacgatcttcaagagtctcgccatctacccaacagtcttcaggtctgacacccacgccttcgttctcccgaccacgcacccgggcacctccgaggccgccggctcccgcgccggtcaggggacgggcctcagcacctcccaggccaccagccccagttcagcaatccaccaaagacaagggtccccatagacctacgcgacctgtacttagaggcccagctccacgccgcccccctccaccttcaagtcccaatacatacaataaacacatgatggaaaccaccccccccattaagggcaataacaactacaattggccatggctgtaaataaaatgtcataacctggagtctgcatgtctgttgttttattcagtaaaccagtagtgcgcgtgagttctttagggcatccacgatgtagccgctcgcggggttcccctccccagtgatcatctcggataggggattcctgtccatgaccacgcaattagagtgccgggcccgggacagcgccacatacacatggccgggtttgatgtttctgtggctgccgaagcagatggcgactttgtttagggacagaccctgggccttggctatggtcatggccagctttgagctaatgccatagtcacggatgctgcagaggttcagggacttgtcctctatcgtctcatacagtttgttagtattgtgttccaggcagcacacgaagcctgcctcatccttgaccattagcctgggcatgcgtgaactgccagcgtcctgaggctgctgctttcctcggatgccaaagaagacgttgagatgcgtgtagcccagaagcgtgtagttctcggtggtggaggcgtagtccaggaggccgtgaaggagaggctcgtctgaggtgaactctatgttgtcgcgaatcagcatgttgttggtaaatgtgcagaaggggaggtccctgaactcccttccgccatagcggacggccacatccaggcattgcctgaaataggccctgaggtcattatatatgtttaacagggagcagaggggggcagaatttgcggccgggggagccagtactcgggcatagaagacagcggcggggctccgctccccatcccaggcaacctccagcggcagttcgcccagctccatcccagcagtcacctccggatcccacgtacgcccgggcaggggcacagcaccaagctccgccacgtattccccgttttcacagagagaatgtcctccgtggctaaaagcgtagatgcctccgtagatgagtcgggccaggaagctgtagacatactcgggctgctcatgcccgtgggcctccacgaagctgtccgcctcgagcgtgtccataaagtccccgaaggtgccggtatagccacagatggactttttggtcttgcagttgaccgacaccgagctgtgcttgacgtaggtgacattgtaggtgaccttgacccgttcttcgtcctgctcggtgcccaccgggaccatgtcttggtcggcgaactgcgagtagttaccgaggcgtgcataattcttttggagccaggtgtgggccgtgaggcccggaagcccgaccagggtcttgtactgggccaggggatcgaggaagacctcgcactccaccgggcaggtaaacatggtcaccccgcccccatctcccccggttccccgcgcggcacgcccctgcccggcagtcttgagcgtggcatggagggtggtgaggaaggtcttgacctcggcgtgggagaggaagagccgggtccagcccacgtactgcgcggggtccattatggccgccctggggacgacgaagcggtcgacgtaggccaggatgtccggcgagagctcgaggccgtactcgagggtcttcatgaggtgtccaaactggacgtcggtgcagcgcttgttgttgatgaagagggcccagttgcgggccacgtccacgtaggtcgcggccctggggttgcccaccaggaaggtgaggatgttgtcgcactcgcgaatcttgtttacctgggtctcgtggctaaaggaggactgaaaggcgtctgtctgggtgggagagcccacgcagacgatgcagggaatgcggccccggcggtagagtggggtacgcagccaggcgttgaagaaccagtagcaaaagaccacggctgttagaatgtgcacggaaagcgttccagcttcgtccaccacgatcacattggtggtccatagctgcccctggtgcatgtctctcaggacctcaaaggcggggccagagactcccgagtagagccccctgggcttggttcgcctgaactcggcggcaatgtcggagagtaccggccagtatttggccaggtcccgccgctggagttcctctagggcggcgtccgtagagcgaccatgactgctgacccgctgcgtcatatttatgtggcggctcttgaacccaaaggcgctatagacggttgggcagtaggctcggagtgtctgggagaggttctgtgcggccacggttgtggctcccgtgaccaggcagtccatcgtgtggtggaggcagctaacgctggtgctcttgccagcccccgccgttcccgtaattacataggctgaaaagggcaggaaggggggctccgagagctccgggtcaaactcgggggagaacgtctccatatccgggagttgttggacgcggcgcctagccagggtccctatcctcctgactatacgcctcacggaggcgtctgaggtcatgttcaacatgaacgtggacgagagcgcctctggcgccctcggctcctcggccattcctgttcaccccacgccggcctcggtccgactttttgagatcctgcagggaaagtacgcctacgtccagggacagaccatctacgccaacctccgcaaccccggagtcttctcgaggcaggtgtttacccatttgtttaaacgagccatctctcattgcacgtacgatgacgtgctacatgactggaacaagttcgaggcctgcatccagaagcgatggccgagcgatgactcgtgtgcgagccggtttcgtgagtccaccttcgagtcgtggtccacgaccatgaagctgaccgtgcgtgacctgctgaccaccaacatctaccgagtgctacacagccgctccgtgctctcctatgagcgttatgtggactggatctgcgccaccggcatggtgcccgccgttaagaagcccataacccaagagctccactccaagataaagagcctgagggacaggtgcgtctgtcgggaattggggcacgagaggaccatcaggagtatcgggacggaattatatgaggcaacgaaggaaataatagagtcgctcaactccacgttcatcccccagtttacggaggtgaccatcgagtaccttccgaggagcgacgagtatgtggcctactactgtggccgccgcatcaggctgcatgtgctcttccccccggccatctttgccggaacggtgaccttcgacagcccggtgcagcgcctctaccagaacattttcatgtgctaccgcacgctggagcatgccaagatctgccagctcctgaacacggcccctctcaaggccatcgtgggccacggggggcgagacatgtacaaggacatcctggcccatctggagcagaactcacagcgcaaggaccccaagaaggagctgctgaacctgctggtcaagctctcggagaacaagaccatcagcggggtcacggacgtggtggaggagttcataacggatgcctccaacaacctggtggaccgcaaccgtctatttggccagcccggggagacagctgcacagggcctaaagaaaaaggtctccaacacggtggtcaagtgtctgactgatcagataaacgagcaatttgaccagattaatggcctagagaaggagagggagctctatctaaagaagatccgctccatggagtctcagctgcaggcctccctgggtcccggcggcaacaacccagcggcgtcagcccccgccgcagttgcggcagaagccgcgtctgtagatatactgacgggcagcaccgcctccgcaatcgaaaagctgttcaactccccgtccgccagcctgggtgccagggtgtctggtcacaatgaaagcatcctaaacagtttcgtttctcaatacatccccccttcgcgggaaatgactaaggatctgactgaactttgggaaagcgagctgtttaacaccttcaagttaacacccgtggttgataatcaggggcagcgtctctacgtcagatactcgtcagacacgatctctatattattgggccccttcacctatctggtggcagagctttcaccggtggaactcgtgacagatgtctacgccaccctaggcatcgtggagatcatcgacgagctctaccggagcagtcgcctggccatctacatcgaggacctcggtcgaaaatactgccccgcgagcgcgaccgggggagatcatggcatccggcaagcaccatcagcccggggggacacggagcctgaccatgcaaaaagtaagcctgcgcgtgaccccccgcctggtgctggaagttaaccgccataacgccatctgcgtggccaccaacgtccctgagttctacaatgccaggggggaccttaacatccgagacctccgggcccacgtcaaggcccggatgatctcgtcccagttttgcggctacgtcctcgtgagtctgctggactccgaggaccaggtcgaccacctcaacatattcccccacgtgttctccgagaggatgatcctgtacaaacccaacaatgtgaaccttatggagatgtgcgccctgctctcgatgattgagaatgccaagagcccctccataggcctctgccgggaggtgctgggtcgcctgaccctcttgcactccaagtgcaacaatctggactctctgtttctgtacaatggggccaggacgctgctgtccaccctggtcaagtaccacgacctggaggagggggctgccacccccgggccgtggaatgagggcctgagtctctttaagctgcacaaggagctgaagcgcgccccatccgaagcccgggacctcatgcagagcctctttctgacctcggggaagatggggtgcctggccaggtcacccaaggattactgcgcggatctaaacaaggaggaagatgccaactcgggcttcacatttaacctgttttatcaagattctttattgaccaagcatttccagtgccagaccgtcctccagaccttgagacgcaagtgcctcgggagtgacacggtctcaaaaataattccctagaataaactgagaacagtcatcagtaaatctgtctctcgcgtgatttccataggaatggtgtagccggggtggagggccgatatcacatcaagcagaaaggccataatctctcgaaagtaggcggtggggctgagaccatgctcagtggccgtctggcagggggccgggcgcgctccgtccttgtccaggagacacacgtggcttccagagaggcgcagcccagccctccgcagccgctgaagccaggctcgcggaagagcccaaaacctgtttcggcgccgcccgggggccagtctccgggtcaggtcgcggaccagggtcaacaggtggtcgtgggatggcggggccttgtctgcctcgggtctcgccgctagttggtccagggtccaggagaaggcttcgtgccaaaccaaaaagggccccgagtgctccctacatccacccacgtaaagatccccctgaaagatggccatcagtaggcacccgggcccgcgtcgagccttcacccgaatgtgtctgcgggccacggtggcctctccacccatcacatcccggtcgagccggctggcatcctccgagtctttcacgccttgcaggaaagcctaggagatacagcaacagaaagctattagccggtggttcccccaccatcattcttcctgttaacgggaagaataagagttgggcaaaccccgggggccgcgctctcccacccagccccgcttctcacctgtgctagtggctcctctgaaggatgggcggaggttggtgccacaaagcccaggatgaactcgtctgcataagcccaggtcagtcctaggtcagcggccgcgtgtaggagaacccgggtgacggcggtgtagaggcccccgagtgcccgtcgcgtgtctgaggtgccatagcggtgaagggcccgcagccaggtttgcgcgtcccgcgcctgccctccgccatcaggcgttcccacgggggcgcccctggcagagaggtggcagcgggccaattcgtagagccaccaagtggcatcagcctcaaggatggctgtggcctccgcgcgcccgaccaccgtcgtctcgtcctccccccctccctcgccgccttcccgcgtgcaaacgtggcgagggttaatctcctttcgggtcgggggccagatttgttgtaggagcagcgagccgcgtcgttgccctgaccgcgcgtcgaggcccaggagggcgtctgccaggggcgtcccagagactcccaggttcaggtccagtagcaggagaccctcgctgtgtggcgcccggtgccagaaggccggcctcgcccgtcccacataatggatgggcaggaagggaaagcccgggacatagggctggaaatctgagccccctgggcagagttcggggtccaggaggtagaagatgggcttggtgcctctgtggttggcgtagcaggaggcatagatactgcggaggaaggcgtagagcccgcccccggccatactccaagagttgacaagccaggactcgaatcccccagccggctcaagaattttcaggctgacgcggtgccgtcgggcgtccccaccacggccggtggccccgtcggacgacaccagatctacttcataagtgaccggtcgcaggatgtccctaaaggggacgggagaggggtcgtcgggagtctcggtggaataggtgaaaacatccccacgcggtgtcctgatgtatacgtccaactgtccgggagactcagagtgcctctgagcatgggggcatgtctgttccccctccatctcggacccgaagccatcaacaggtgggggttgttggtcccgcccatcatcccccgagcagctttggcagaccacctgtgctggaaagagaggctggaagatgaggccctgctcatcctccaccctggcggcggacaagagtctgcggtctcgggttctaaatgaaaggtcaaataggtccttctcggcggcatcggcgagcatagcaatgagccccccgctgcgcctgagctcccgctcccatcgcaaaaagttgagttcggtagtcgagggcgcgttgaccacggggggctccagggagcctccaagcggcggctggcaggcctgcaccacgatcagagtctcaacgtcctcccttttgatgggcacgatgcccacgacccaaatcgcccaccaccgccctgcggtctgggtaacattataaaaggtaaccgagctgacgcgggccctgacgctctccgcgggtgtttccatcattgtttgagatctgaggaggactggaccctttaaaacatccggtcacgccctttgcaaattatttaaaaggtgaatgctcaactgagaccatcgcaatcatgaagtcctccaagaatgacacgttcgtctatagaacgtgggtcaaaacgcttgttgtgtactttgtgatgtttgtcatgtcggcggtggtccccatcaccgccatgttccccaacctggggtacccctgctactttaacgcactggttgattacggggcacttaacctgaccaattacaacctggcccaccacctgacccccacgctctatctggagccgccggagatgtttgtctacatcacactggtctttatcgcggactgcgtggctttcatctactacgcctgcggcgaggtggcgctaatcaaggcccgaaaaaaggtctcgggtcttacagacctctcggcctgggtctcggcagtgggctccccaaccgtgctgtttttggccatcctcaagctctggtccatacaggtcttcatccaggtcctttcctacaagcacgtctttctctcggcctttgtgtactttttgcactttctggcctcagttctacacgcctgcgcatgtgtgacccgcttctccccggtctgggtggtcaaggcccaggacaactctattccccaggacaccttcttgtggtgggtggtcttctacctgaagcccgtagttacaaacctgtacctggggtgccttgccctggagacgctggtcttctcgctcagcgtgttcctggccctgggcaacagcttttactttatggtgggggacatggtgctgggagccgtgaacctcttcctcatcctgcccatcttctggtacattctgacggaggtgtggctggcctccttcctgcggcacaactttggcttctactgcggcatgttcatcgcctccatcatcctgatcctgcccttggtcaggtacgaggccgtctttgtctccgccaagctgcacaccactgtggccatcaatgtggccatcatacctatcctgtgctcggtggccatgctcatcaggatatgccggattttcaaaagcatgcgccagggcactgactatgtccctgtctcggagacggtggaactggagctagagtcagagccgaggcctaggccctcgcgcacgccatcacccgggcgcaaccgccgccgctcttctacgtcctcatcttcctccaggtcaaccaggagacagaggcccgtctctacccaagccctcgtctcctccgttttaccgatgacgacggacagcgaggaggagatcttcccctaatgcaataaaaacttaaaacactgaggttactttcccgtcattctttcgggggaacgaggggaggcgggaattgggttaagataggggcgaagggtgggggtgggtgcaagaattggggctgggaatggagaggggagtgggctaggtgccgacaccggggtgccaagataatggattgagtaagcatggggctctgatcgggtccgccgggttctcaggggtgtagtgggtgggcattgcatatttttgccgcggtgctgttgggccttggactcggggtgatcatccgtaccatcacccgcacccgcaccccagtccacagccaccggccaaggtcctgggcctcccaccaccgttatgcctccccctttacccattaattacaagagatgttagtttggttttttatttggcaaaaacagcaattcatcattttcagagtcctcatcatattcgagcccctcgttggtttccccgcaggccctcccttcttcggccgctattagcttagtagtctccaggttaaactcctcatagtcattatacaggttgattattcccccgtccacgtcgcctatggagttgactcgtcgtcggcaaagagaccagagggcacccatggcgcggtgtcaaaagtattgtctgcgtacgctttccaggagccagccgcggtgctcaaggtcttacggatgacagagtccggcaggaccacgggtgtcaccagcaccgccacgggaatctccaccgaggcgtccagaagcaggtctgagccgagcgtgcaggtcgccgggtctagaggcgaccgttttcgaaagaaggccgtcacaatgttcacccggggtgagcagtctctcccgggcttgccacccccactgtggcggacgtagtctccaacaattttgtattggaggagcacctggtagaagtagttgtgccgtggattgatgaagatgttgactgggacccggtctttaataccaatgcgccccgcattttcgcttgggtccgtcattacgtagagcatagactccacccccctgttggcagctaggctgtctgccaccaggtcatgaccggggcccagtttgcgcttacggacatctttaagattccaggcctcatcctgcgtcaacagatagtcaccctccgagggcaaccgcccatccgggacgtactccacggtaggacgagctatagaattgataaatctgataaatgacctcttgcatggcctcttgtaaagcgcagtgtaggatgggtagatggggtcaaattctgacttggaaaagaggtacttgaagcggcacttaatctcataaatgcagctccggtcggtgaacagtataaagtctccctgtgactccacattgacgcaaagatccagagacaccccaaaaatgccatccgtgggactaatcataaagccaaattgacggttggcggatgcgtccccgcagatgagcttacagacaatgtccttgaccgtgtcctcacaccgcaggccaaaggccacaggtcccccaaagtagtgatttgtggagatgggagctggctcaaacaccttggtgggtccattcttaatggtggagagcagcttggaagaggaaattatgccatttcgcaatatgtcccacatcaggttctcagactgccccctggtcatggactccacgtacgagcagagaacagtcctctgctcgtcggtggcctcctgtagcccccagtaaatggatttcagggagggaccgtccttgctgtcattctcttggactaacgaggagacaaagtcacagaagccagtttcaccagagaactcttgtatttgtttacagaggcaatagagatagacaaagcgcatggccggcatctgaggtggacggtcaaggttacggacaaaggcctcagtctccggactgcggaggaagcgggcaaacgtgtaggaggtcatctcctccatgggatcctcgagctcatccacgtcggccatctggaccaaagaagtcgtctgccaagagttcagctaccagacctggaagatgagggtgctcaaaccgtgggcgacagttgaagaagtagctctccttgaacctctttttaaggctccggcaccactgcaagaattgactcatatgctccgccgtgacatccacgcacggactctcgccacacgaggtcaggcccatgtctaagttcaggttccacatctgcgacagcacctccaacagcaccacctttggggctgcaaattgcaaaaagtagagcgggtcggatcggtcaaatcccatgtcagggttggggtaggggattttgtgggtggagtcagcgaggtgcatgataccatagagcagcgagtagccgagcgactgcagatccaggcgaagggccgtctgcgcccccacggggccacacgccgaggggtcagggatgtgcccagcccccctcaagatgtagcacttgctcaaaaggcagaggggcttataggtgtccttggctatagaaaatggttccctctggcaatagaggcgatagagctgccggcccttagaagactttagccgcacatccagcatcttgttgcggtcgtggagggaagcagtcccataatcagtcaggaccagcctacccatgccccacatggtgtctgtgaaatccaccaggatgttgctggggctaatgtccgaatggaagaggccgcagtgccgattcagaaagtaaacggcatctttgaggccctgaaagccccgcaccaggggctcaatactaccatcatgccagtggccataatcctggagactgcatctgaactggggcataaacagggcgtggcaggacgtgcaggccgacaggtagtccaccagggccttgtcctgcccatcctcggccgtggccttcccaatctgaatcatgtcacacaccatgagctcgtgatacagctccgtcacagagtcatagagtttgaccgtggcattatctgcatgtgcatacacggccccgtagctcccccgccccagcagatactcgcaggtaatggggaggtgatcacagcgcgtcatgttctccggcagctttacatagagggtctccgtcatgtcatcaatgttggtcaccttcaggtgtttgtgctgaaaggtgaagtaatcaatgacagtcaccttccccaaaaaggcctgggtctctcgagggggttctggggagacactcaactcgccactgctggaggagttcgtcgggctcaactccgcagccatattcacatccatgttcctcaaatggctcgagggcctgtcgcagctcgtctctggcctcaagctcctgctcacggagctcctccacccgctctagctgcttgtagttgatttttggaaattgagtcttggtcgcggtgaccaccctctgataggtagaaattagctgtttggactcaaacgtctcccttgcgtggcgcagggactctaaggcaccccgagcagatgtaaactgtgtttcaaacagagcgtggtccctcccaaatctgtcacgtgcgctcacagccgctctcttttctaccgaggctcttagttgctgggccaccagatctcgcttagaactactcatcttcataagtcaccatgtccgcaactatggagcccagatcatacgtggggtagagtacggtagttccagtggaggcttcccggtaatttcccacagcgtccaccatatatctttctgcctctcccgttagaattaggcaaggatcatacgtgtccaccggccttttatactgagcgtttaggttttgtttatgtagcaagcacaaaaggcacacacgagtgatgcaaaagggttcctgaggcagcaggcagagctgttttgccattttattcaggcggctaacgtcaaagggaggagctatatcctcacccttccagtcacgcacgtccaagtacagggcatacacacacctggtgaggtgtgccaggaatgcctctatgttggcacatggtgtataaaccgcagtgggtagcagaatagggccccttttgccccgtgccgcagcgtaaacgcagtgacgctcttcgcagtgggacctggggccgtagaagagggcccacatccaagggagtgggtcttcaggcaccagggaggtccaggtttgggagtgggccaatatttgcaaggcctgacctataacctcatctttgttccaggccagcgcaattcgcataaggtccccatcaaacacctcaaaacacagacccatgcccatttcaggctgagagggctccatccggctcgaccaaccttgtccaccaaactgccattcttctggtaaacgggggttgaggggcaagagctccaaagccaggctcgagaagtcatagtcatcctcggccacacggccggagctccgggcctcgtgccagggcctgttgtcctgggggaggatattggacacgagcaggaagctcttgagtggcgtctccaccagcttaaattgctcgggcgtgtcctggcaggcctccagtgccagttccagacactgcccatacctgcgggcgagcatcgggtcatcgggcatatcggccttgaccgcgttgaacatgctgtatgcctcgcagcgcggccgtctgaccgagaacctaagaaacgcccttcagcaggacagcaccacgcaaggctgcctgggtgccgagaccccgagtattatgtacacaggggccaagtcagacaggtgggctcaccctctggtgggcacaattcacgccagtaatttatattgcccaatgcttcgagcatactgccgccactatggccccaggcccgtgtttgtagcttctgatgaatcattacccatgttcggtgcgagccctgcccttcacaccccagtccaggtccagatgtgcctactaccagagctacgcgacacgttacagcgcctgctgccaccacccaatcttgaagactccgaggccttgacggaattcaagaccagcgtgtcctctgcccgtgccatccttgaggaccccaactttttggagatgagagagtttgtcaccagcctggccagcttcctgagtggtcagtacaagcacaagcccgcccgcctagaagcattccagaaacaagtagtgttacattctttttattttctgatctcaatcaaatctttagagattacagacaccatgtttgacatctttcaaagtgctttcggattggaagaaatgacgctggagaagctgcacatttttaagcaaaaagccagcgtgtttcttatccccaggcgccacggcaagacctggatagtcgtggccatcatcagcctcatcctctcgaatctctccaacgtgcaaataggctacgtggctcaccagaaacatgtcgcgtccgccgttttcactgaaattattgacaccttgaccaagagcttcgactccaagcgtgtagaggtcaacaaggagaccagcaccatcacgtttaggcacagtgggaaaatctccagcaccgtaatgtgtgccacctgcttcaataagaatgtaagacctgacgtttcagtacttggcaattgtagagcatagcccggctgtaaaggtcagaaaatcgcagcagggtccaaggttgtgctgtacatgggacctctttcccattagcaagaaccccctgcaggacacgtgacatgtccgggtgcattttgggtgggttaaatctcagtcccaccacaaagggggcatcctccggtttgaacatcagacccaacaaagcccgatgcccagttatgggtacgtagtcgttgttcagggccgtgcatggcagcagacaaggacaggtgccagatgtgcctgggctatcgtcctccgtccagccacgcaggatgttcacgtgggccccggcaccatagcatgtcacacattccccgttatcacatctggttagcaggttgataaaatgggtcagtgatggaaaggttggcatattggggcagcacatcagcatgtccatgttaacgaaaaacatgtacagggccccttctgcataccaggcaccaccccgtcccagtgggatgatctccgagggtgtgatatcttgcagttcttctactgttttaacggcggttgaggtggtaaagacgtgggccgtggtcagatctgtgcaggtgactacagggttacccctaatctccacaggcaccgcctcacccactgcatctgagaataccccaaagtacatgagagtcaggctgtgtggcccctggactgccttagtgaagagaacctcgggcctggccacggtggctagggttccattgatgtagacggtcacataggtgggcttcttcttgggcttcagcacaatgagggtaacattcatgtaggttttaggaggtccggctatctgaggcacgtacacagctgacacggcggttgtggccgtatagactttcatctggggcgtagaggcatcgctcagcacccagaggcactccttgttgaggaacttgcgaagctgttcccggctactgttcgcggcggatgccatgacgtgccagaatatatcccctctcctcgggggtgagtgccaattggcctttaataacaaagcccccaggcagcaccaaaaatgcctgcccgtccgatgtggtggccaggtggacgcagtgcccgtcagttccaagggctactagctgggaagcagccccaaccagcccacccgggggcctggagtcgatcaccttaccccaggccgaggccccttcctcatacagcgggtggctatctatccataggcaggcatccggcgtctttggtgcattggagatagtagctttcacccaacaactttcccaactaacccgtgtctggacagtgaagaacgcttccctgatcaggtctgaatttttatagatacgggagtaggaggtgggaataacaactgggatttcttgttgtgctgtccaggcctgcatggccagtttttccctgaagctagcagaaattctgagggccactgaaatgaggaagcgaaactccctctctggagctcccaaaattgaaacctcagcaagatctgttgctggggaggcatgggtgacagctgtcatcctgtgcagtctgccctgggcactcagctctggatatgtgacaacatagagagcgtgggggctaaaaatatgagcaattcccctgaccagggccctggactcacgaatggcccgacgggtcttagagaaagaaacaggcaccctcgagagtgcccccgacccgacccccacagtgccgccagtccctgctcggcctccgccgccttccccaccggcgctgccccggatgttgctggggttctcgagggctgggtggtgcttggacacagaggtctcagcagccgccttggtctcggccccggccctaagtctgagccccaggcaaagggccggactcccagcgtggcccaacctctgctcccctctattctcctcttgcgttatctccaatagaatttgcttgaggtcatacgttttagggtgctcgacctgggccgcggccaccggcatatgctctatacccgcccctccggggggcccaggatctataggtatgggctgcatagccgcagcagactcctggaccccagaggcctctctgataagatgcccgtcggtcagagcccttttggccccctcaaagagagacaggtaataaatctgtagctccccaaccagccctccttcatcgtaaaatcgaagggcggccacgtggaaggggttgtagagctctggaaggccctcatcgcagtacactggcacactggtaaacgtgccccgatggctaggccgtccgggcagcatgccccgagcagcaaacacgcggcagaccctcgtgagacccgtccggtcactgaagagagtctggcaccaggccccctcgcagtttggcacgcgattggggcaaagctctgccataaccgtgtcgggaacaaataggtgcacgaggaggggggtcccgaggccactcaacacttggttgtcaatgtggacatccatagctctctcatgcgtttggctacagcatcatagcgcttgtttctggtggatttaaataacagggccccgtagacagtcttttgtgagtaaatagagatgatgacatggatgtagagactgaggaccacatccaccaccttctcggaggaggcccccctaaacagcatcaggcagcaagggaacacaaaggaaaccagggccgggatgtgaggcctcagcgccccctcctgatcaaagagggcctcgctgaccccggagatgacattctcattcagaaagtagtgatagaggtgattgaccacagtcttaaccaggccctggacttgttcaggctcccacttgtcccgctggtcctgtgtgtcttgtcggatctcggtccagggcctcagcgccggctggaaatgcggccccatgtagttgcctgtaagggcgcacaccactccctcatgggtctcaatcagggtgcactcgctggatccatcacatacgtggtactcgccacagccccagcaggcaaacacggaggccatgctctcaggtaacgggagatggaactccagcttactatacgagcacaggtggcgaggattgggctcatccgtgcccccctccccccgcgggaggctcaatcggccttggtctgacattccaccccggccaggtccaggagggtgcaaatattctccaggcgctgcacctcagagacctcctgctcaaagagacctcccaccgccacgtagacgcgggccaccgtccggggaaggtcagtggggtcccagctcagcaattctccaaattctctctccccaatagtgcctcgcttcttatcctgtctttcagagcatccgggggcagacatttcacctcttgtttgtggacgaggctaactttatcaagaaggaggccctgccggcgatcctgggctttatgcttcagaaggatgccaagattatcttcatctcgtctgtgaactcggctgaccaggccaccagctttctttataagctgaaggatgctcaggagcggctgctgaacgtggtaagttatgtgtgtcaggagcatcggcaagattttgacatgcaggacagcatggtctcatgcccctgctttcgcctgcacatcccgtcctacatcaccatggacagcaacatccgagcaaccaccaacctctttctggacggggcctttagcaccgagctgatgggtgacacctcctcgctgagccagggtagcctgagccgcactgtgcgtgacgatgccatcaaccagctggagctctgccgggttgacaccctcaacccccgagtagccggacgcctagcctcctccctctacgtgtacgttgatccggcctataccaacaacacatccgcatcaggcaccggaatcgccgccgtgactcacgacagggcggaccctaacagggtcatcgtcctgggcctggaacacttcttcctcaaggacctaacaggggacgctgccctccagatcgccacctgcgtcgtggccctcgtctcctcgatcgtcaccctgcacccccacttggaggaggtgaaggtagccgtggagggcaacagcagtcaggactctgcggtggccattgcctcaatcattggggaatcctgccccctcccctgcgccttcgtgcacaccaaggacaagacgtccagcctgcagtggcccatgtacctcctgactaatgagaagtccaaggcctttgagaggctcatctacgcagtgaacacggccagcctttctgccagtcaggtcaccgtctccaacaccatccagctctccttcgatccggtcctctatctcatctcccagatcagggccatcaagcccatccctctccgcgacggtacctacacctacaccggcaagcagcgcaacctctctgacgacgtgctggttgcgctagtcatggctcattttctcgcaacaacacagaagcacacgttcaagaaagttcattaaactttattgactacaccagtcccttgtaaagcgacgggtctcgcgtgacggcattcgtgagcagggcttcgtccaggggcttgttcttggcggacatcattagcccagccgcaaatatcagaattagcatcagaaaagtgagccccacaaacaccagtgtccagagaggaagaccgtaagataaagatggctgcctctcatctggaacggtgggaagctcagcagttgtttttgtggcattggacgtccctttggaggacagcgtgggggccaaggtggtagcgttggtaatacgggtagtagcactggtggtggaggaggacctggtggtgacattgctagtcacacccgtggaggttcctgttccggcctcggtggcagtgatgttctgtgcagtaaccttagtggtgacattgatggtggatgcgttggaagttgttgggactggtgtgacagttgtcccagtgaatgtcaccgtggttgtgttggtgctcagaatagcagttgtggttataggggcgctagtcgtggtcaaggtcgtagactggtttgtgctaggacccgatgccgacggtgatggtgtagtcacagccgttgtgcctgtcacgttccccgccgaggccgtcgaactgccactagatgtccaaataaggcttgtctcacagatgagtatcatggccataacagcgcctgccttgtctctggcgtgtgccatcgcgtctggacgcagaaggcctcccggcctcttttatagctagtctccacacccaatactctactgaaccatcacatacatgacctcctcgaggtatgcagggaatgagcggtccgtgagccggtcaacacgacattgcttccgtttcatgcctccagctgcccctgaccagttaggacccttgacggatgtctttaacggcgcggtgcagttggtcaccaatgacggcctaaaggccaacacatccttgaagcagggcgtaggaatggtaccaaactcggggcccaccccatcaaagacataatatgtctcatagtggcagtgatgatgcatcaccaccacagcactcgccaggaccctctgcatatcttgtacaaggcgcctttcaactcggccactggctctggtgacgttaaatgtcctgttcctattagtcacagcctgtagatttgggcacccagactcaaaaagtgcagctacatgaagggcagccgcctcaaatccaccatgacccccatggctgtccgtgttgttggggtaataagtcacattgttaatgaccacggccgggataagggtgtaaaccttgcagaatggattggtcggacacccataagacaggggcaccccaaaatcacgccccttaccccgaagcaccttggcccccaccggcataaagctgggcaaaaagagtgggttaaaaccaaaggcgagtagggccaggaacgccaaatagcagcagtaatagatgaaaacaaagctcagcatgaaacagcgtggaggctcagctagggtctctgcctctccatcatagacatcttccttgaatctcattctctcaccgcatacctcgctcttcatccaggagggggccatggctgccattctaccagttaacgaggagagagagagtaggtccgcggaaattggtgcccctctctgccctcctgacgaggccatggtgtcatccatctccgcagtccgttcttcagctttggcattggtccgggtccgggtggtctgattttgattctgatcctgggtattggtcttggtctctcctcccccattggcatggattggcataggtgggtgtggctcaggctcaggttccggccctgggacggcagcagccgccgggacggtgaagtcgtggaaggtagaggcccgtccctcccgaggtcgtggggccggagccttataaaagacttccaccctctccccgctggccaagacacgccgctcgtggaccacgccatcttcctcccggctgattgtgtggctgacggtgccgtgttccaccgccacttgttcatcgaccatggtaccccctttatcttaaccagcaagtggccgtcagggtctcttgagagtatgccgctgtggccaagcgaggccccaaattaaatagtgatgccaaagactgtaggtaggtcatcatcacacgcatgcgtgataaatcatccgccactgacaggtcatccaggtctatccgggctatctcatccggcaccatttcctggaagagattcaagaggtcgtgatgctcatgccggataaggcctcggaccaggcgcatactggccctgggcagcagggtcaccatgatgcaaaagtagagactcagattgtccagcagggccaagccaaggggccctggcacctccgggagggccaactcgtagtggtgccccaggtatgaaacagagccaagatgcatgtgtacatcgagcatgtctgcgttcccgggagcctgcatgacaacccgggagtacacgttaaacaggagaatcttctgcagcacctcctctgctatgggcgtaggcagcaccatggggaaaacaatgtccacatcattggactctaacttcacggtggcatgctctcgtccaaataccgggggcataacactgaggctcccggtcccatgccactggaaaaagggctggtacttgttcttaatggcgtaggtctgacctggaacaatcttggtgagtatcaaactgtccacgctaacctcatccagcacggccagggtgcaatcagacaggtagttgtacatggacacgtagtccgggaccgtctctagagagtacacctgacccaagcccaatccctgcacattctgcgtcccgtgagtggaagccaggggtaagatgcagccaatcctctgttgcatcttggcaatctcatcggtatacagacgagaggagagagacactaccactttcaaatccatctttattgacaattatcaaaaaaccaccttatttccaaactttaatattcttcgtaccggcgccacctcttcaattatatagtgtccgtaatggatgggggcgtgggtctgtttgacagacataaactcatcgatgagtgcccgggaggaggctgagagtgcggggaatgcctcctgcagaaagctgcagggctgctccagaaacacgtcagtgccagcaatcactacaaactgcacctctgtgttgctggtggctgggtgccctccaagtcgctggctgtactcgttgaccatgttgtagagtcccctgttgttgcgcagaagctcctccttgttgaaaaatgcccggcaggggctgtagaggcccgggacggccgtctggcgataggaggagttgtacatgatgtcacccagagaacccagctgagatgcccagggattcacagtgctccggtattcataggcggcatccgggcgagaatggtcatagatgagcccctcggcaacctcctgattgtagttttcacaggagaccacacaggcggcccgtccccttggagagttggacttttgaaaataagccacgtctgccgtgaccggtgttacgataatctcacaggtggcctgctggccgtggcagagtcctggagctccattaacattagtcatacctgccaggtatgtcctggggtcccgaagcagcgtcccattgcgctgagcgcccaccttggccttgatgtagtcattgacttgctggttgccaaaggcctcggccggaaagacgctaaagaagtcttgggtgtggatacccatgtcagtagtgatggccgccaccctggccggagtcatggtcgagctataactaagcccggtgtcgatggaggccatctcgtgatgcacctcaaaggttaccgcgtccaccctggcctcccggcggctaacatttggggtcccaatgaacatggatgttgaggccctggagctaaacaatatgttttcagagaggatctcatcggtcctgaccacggtcatggccacccctgggtggatcttgagcttggcctgggcaatataggccatgggggacatcttgatgtgcatggcggtcattccactgattgaaacgagggaaggaagacattcggccgcgtatttgcccatgggcgagcggtgccactcccggtactctgcaaagagctgctctggccggttgaaggcttccacggcccgctgctgaggattgcgcataacaaaggtggcaacatcctggtgcatggtggcagccactcgcgggtccccgtaaaacatatggaaaggaatggcgtgaaagagacactgggtgacggcccgggtcctctcggagaaggcaaaggccaccagcccgttcaccaaaacagtctgctctgtccgcttgtcggcgggattcggggccagctgctgcgtaacgtcattgtccaccgacacacgcacggcacgggtgaaagtggggcaggtcatgaatgaggcgctgaggtccctgatcatgcccacggtggggcggaggtcggagatctccagcagatccctgagcgtcccattctccaaattgtcgaggatgtcctcgtccctggtaaaatggtggctgaaggctggcccgttgtaggccagggtctgggccacgtgctgaaagtccaccccgaggccgcacatgtgggcattggtgcaggttgggaggaaaacgtagtaaaagatcttttccagcacatccgcatgcccctcatctacataagggcctaggtgcagacggaaatcgtggtcgtggtctccgttaacccggtagccgtacaaggccacaaattgggcagccatctcatccatgtttccaaccctctcaataaactggggcgcggccagggtgtcagcgtaaacctcatttccgataataatctggggggcccggtcactaacggtgagaagatgggtgaaaatgtctgtgtaggccaccggggggagcaggttagggtccaggagagcgcagacatactgacccacgctctcatcccccacaacatctgacccggccaggcgcatcagggcctgctctagggctataagttccccatagatttttctatacatggaataggcctccttggagatggcgttatttcccaggtggcggcagatgaacttgatcatggaaaagctgttcacaaaggcaagcctccctgaccgttcccagtaggtgttgatgcacagggacaccaaaggcacgttcatgacaaacttttcctcaaacccgtggatcatagcctcgactacgtagaagaaggctggataggcagtgtcataggcagtatcctgcacagtctcaataacggcctgatccaccacgtgggccagagatgtggcggtctcaaactgctgcccccgggcctcttggaatgcagctggggccaggggagtcggcaggttacccaccattagccggtgcacagccctgtgcctggccctctccccggcatccctgccaatgtaaatatcataaagggggtgcagctccagccgcagcaggtcataattggacgggtggaggaagtcttcggtgggcagcccgcacttgagagctatatctgtcacgggggctgcatacttgttatcatagaactcgtccacaataacaagcacattcatgtgattgggcctcctgtgttgcagggagtaggtctcgcgcctgtctcgcggggccggggccgcgttgaggctgtttagggtatgggcgggtgtgtggagtcgggggtgacagagaaccttgagagcattctgtaggttaaacgcgaggagaaggttattcttgtttacgatccatgcctccaccggtagctgctgtgtggggttgtccagcattttgatggcggcggaggtcgtgtacttgggattgggcataaacaggcccactgggaaatagtagctgtactgcattcttctgttgagggggtatggggactgagtgtcattgtacatcttttgcaggctttccacggccaccgcgtggttgcccagcttgatgacggcggctgagatcggcacccggggctgatcctcgacccctgcggccacagccggcaggtcagacttggtgcttccggctttttccggtgagtccacgatcctagccatgaaatgctcaaacgtacgcatcacgcgcccgtagctcacggcagtgaccaggttctccccccgtaccacaaaagaagcatagctcgagggccccataatctggttgtcggcctcctcacccaggaaggtcaagagctggcgcagaacgttgtcggtgacaataaacaccccccccactggctctccccccttggcggtcgtgtaggtactgacccccttgagcacgctctccccggacacggccgctaccatctcagagagacggcttcgcacgtactgagaaaacccggagcccatgttctcggcccggtccaggaagaaggagtgctccagcagatgcctcttgaacatggcaatgaggtcagacttgacagtcttggagaaccccctctcagtgaaggtgggatccgccagggtctgcaggataaacatgggaggggcatggcgaagcttcacactcaggacggtgttaatgaggcccctctccagggcatcgaccccaaactgtagggccgaggccacggtcttgacagcccccacgtactctgcgtactcgaccggggtctcggggatactatgcaggatctccagatccagcatggacagttccatttccgtactaatgtggtgtttgtggcaatttttgaccacaatgaatgtccgctgcttgctgggtctccttccgtccccgtgagcaatggtggggacggagattcgaaattgaatcttgccatccgtcatacgactcaggtctttgaattccgtgttcacacaggacacggccagtgccgtctccaggaagcgaacatattggatggcgttcgtgtagaccccgagtagcacctcaaacttgatgcccgcctctctggcatccttgcccaccagcaggtcaaagctatgaaacaacccctcagccgctgactgccgcaggttcgagagcaggtcggcatccaccgtcagataggggaagggtctgttttccacaccctcatttgaggccatgacacaaggtaagagggagatggggggaggtctcgagggcttctcttcacagctgggtctcttttacgccctggcctgcaaccgcagcccacccacacttcccgaggatgctacccttctaatcaaatggttggacacggccctgggcagggaggccaccttttacgcgtgtcgggctatgcgtcggcttctactcggcgttatccgaatgaatgactgccaggagctgccacccggtttaataattctgagtccgggcaccgtccctggcccccttggagtccagagtctggagcatacagactgcgaaatatggtcctctgcccaccctgaccacgctgcccacctcccggtgcccagggtcatcacatacaccgactgcccgggttccataaacacgagctcaatgtttcgccttatcatccgctacttgtctcatcaccaatttgagcgctgcttcgagcagttctgccgcgtggtcccgcgtcggcttcctagggacctgtaagcgaaactctgcaaagatgctggctcatctgaatcaggttaccaggatccccccctgtccgcccttcagcgggcgggaggccagactcaagttccacttcttctcctggagcacattcatgctgtcatggccaaacaatgccacactccgggagatcaggacgagggccgccaccaacctcacccaccacccacatctagtggatactctgtaccacgcctctccgcagaccccatttctgacacgcagcggtgctctataccgcttcgtcacctgttgcaactgcaccctgcccaatatctccatccagcagtgcaaggccggggacagaccgggggacctggagatcattctacagagtaacggcggagggaggcccgcgagcttccagttcccctcctccccaactggctccctattgcgatgcatagttgctgcgtccctgctgccggaggtgtccgtggggcaccaggagctgtctccgctgcggtccagaagccagggagggcagacggatgtcaggtcgggcccggacccggcccggagactggtggccctcctgcgaagggaagatggggcacctaaagacccccctctgggaccgtttggacacccccgggggcccggcccggccaagagcgaagacgaggagtctgagcgtcgagacgcccctccacccccgctcgattccagcttccaagcttcccggttggtgcccgtggggcctgggtttcgcctgctcgtgttcaacaccaatcgggtgatcaacactaaattggtgtgctcagagcccctggtgaagatgcgagtttgcaatgtcccccgcctcatcaacaactttgtagcccgcaagtacgtggtgaaagagacggcgttcaccgtcagtctattctttacggacggggtgggggccaacctagccatcaatgtcaatatcagtggcacctatctgagcttcctattggccatgacgtcactgcggtgcttcctgcctgtggaggctatttatcccgcggccgtgtcaaactggaactcgactctagatctccatgggctggaaaatcagagcctagtcagagagaaccgaagcggggtcttttggactaccaactttccctcggtggtgtcctgccgggacggtctcaacgtgtcctggtttaaggccgcaactgccaccatatctcgagtgcacgggcagacattggagcagcacctgatccgtgaaatcacccccatcgtgacgcatcgagaggcaaaaatctcccggattaaaaaccggctctttaccctgctagagctacgcaatcggagtcagattcaagtgctgcacaagcgtttcctggaaggcctgctagactgcgcctccctcctgcgcctggatcccagctgtatcaaccgaatcgcctccgagggcctgtttgatttctccaagagaagcatcgcccactccaaaaaccgacacgagtgcgcgcttctgggtcacagacattcggcgaacgtgacaaagctggtggtaaacgagcgcaagacccgcctggacatactgggccgtaacgctaactttttaacgaggtgtaagcatcaggttaatctaagacagtcacctattttcctgaccctcctgaggcacatccgccgacgtctgggcctgggccgtgcttccgtaaaacgagagattacccttctcctggcccacctgcgcaaaaagacagcccccatccactgccgtgatgctcaagtgtaagcagcccggggcccgcttcattcacggggccgtgcacctgccatcgggacagattgtcttccacaccatccacagccccactcttgcctcggcgctgggactgcctggggaaaatgtacccatcccggccctcttccgtgcctcgggcctcaacgtccgtgagagcctacccatgaccaacatgagggcaccgatcatctcgctggctcgcctcatcctggcccccaacccctatatcctagagggacagctgacggtgggcatgacacaggacaacggcattcccgtgctttttgccaggcctgtcattgaggtaaaaagcgggcctgagtccaacattaaagcctcctcgcaacttatgatagcagaagactcctgcctgaatcagatcgcccccttttccgcatcagagcaccccgccttctccatggttgagtccgtaaaacgagtccgggtcgatgagggagcaaacacccggcgcaccatccgggatattctggagatccccgtgactgtgctctcatccctgcaactgtctcccaccaagtccatcctgaaaaaggcaccggagcccccacctccggagccccaagccaccttcgatgccaccccctatgcccgcatcttttacgacatcgggcgacaggtgcccaagctgggcaatgcccccgccgcgcaggtcagcaacgtgctcatcgccaaccgctcccacaactctctaaggctggtgcccaatccggacttgctgcctctccagcatttgtacctcaagcacgtagtgctaaagagtctgaatctggagaatatagtgcaggactttgaggccatcttcacctccccgtctgataccatcagtgaggctgaaaccaaggcctttgagaagctggtggagcaagccaaaaacaccgtagagaacatagtcttttgcctcaacagcatctgttccacctctacactcccagatgtcgtccccgatgtcaataacccaaacattagcctggctctagagaagtattttctcatgttccctccctcaggcaccattatgagaaatgtcagattcgccacccccatcgtccggctcttgtgccaaggggctgagcttggcaccatggcacagtttctaggaaagtacatcaaggtcaagaaggaaactggaatgtacacactggtcaagctttattacctgctgcgcatctaaaggaaaaacataacaatcttgtgaaccagaaagatacccagagcaaaagcaataaagtacaggattattgccaaaacaacgtgtgctctttcttcatacaggcccgcaatttccatgacagtcccgttggtggtcagcagcagatagtgaacgtggaggttgtcaaaatcaaagtagttggagctcaagatggagttttggacttcctgggaggtgatgtaggttgtagtttccaggccttccttttcatcataactgagcagggcaaagccacaaaaaatgcaggatttctgcgtcctggtaaaattctggatctttggaatctggcggggctccccagccacagcaccctgcgaacatttattcattataacgggggagagaaagagagagctgctgagataggtggtgctggcctcgtatagcgccgagcctcggacctcacggtcactagagattatgaatgtcacattgatgagcgggataatcatcagaactttgtcgagcctgtccacgcatttgtaggcggggagatgccacgcatccctgtcttctcgctccaaagagagccgcccaagaaacccatccacagcatttgaaacggccgcctggtccagcgttgcctcctggggggccatgctcagcagcttgtctcgtgtgaggtcaaatcgtaggctgaggtagcacggtgagaagagcccgctctctgtccccagggctagcccccgcaaaacctccccaatctctagggccgagcacagggcggtggacagcagttggtatagggcaaggttgggcccctgggtagtcacgttcagccgcaactcgcgtagcaccacgtggctgccgataaacagggtctctctcatcacggtatgcaggggctggaaaagggggtggcggttgtaggccgagagaagcacagatgtggcgcctccaatgaggccactgtaaaccccggccttggggtagccgacggtggctaacctcagcgcgtactcctgtttctcagtagtcaggtgacccagctcctccatcttgaccgtggccatcagcatggcggccaagcgctccagcccgtaggattgcatgcccttgacagtggccccataacatatgccgatgatgtctttcaggacagtcagctcaaagaagctcttggccaaccagcggaggtccacgcagccattgccagtctcacccacagcatgacccaccttaaagaaggccacagaaacctcaaacatggtagtcagcgtttccgtgtccagttccggctcccggcagcctcccttcatctccagcaggaccagtttctggagaacgtagcgagcgtagctggcggctgtcatggtgacggctcgggaaaacatatccttcaggttgggtacaaagtagttgtgaaagttggcataatgcacaaaggttgtaacaatcaccagggaatagtccccgctttgggcactggttaaggatgggtaactaaaaggccccctcagatccggcaggtccttcgtcttgccaaagaccaggctcaacacatgctcatctcccttctcggtcactcgcttgtaggtgcccatcagaaatttagaagtcatggcccccgtgtactgaaacttgtccccgttgatggacagggccacataagacaagtgacagcgcagctgataaaagacatagctgtgtggccgcgtgttgggcagcatggtgccaatatagtagaagagctgcttctcaaggggggcactaagcatgcaggcaggggaattcaggccgctaatgactccgggatggaccttagatgcatccacttgcatggatccttcagagacagcagggatatcgacaggctcggccagcgcaataccaagggtaccagacgtcttgtaaattaacttgtagcggttaagcatagacgccaaatcttcggtgacatttgcctctctccacagcgcctctgggctaaggcctgggacctttgccatcagttcggtccatgggatggtgtaatgcgaagcatgcccctctatgtccaggtgcagcttaacctcgctgaggctggcagcccccacctcccatagcaacaccaggcaaaaaacacagagcaactgcatcctagtcccgatttcccctctcaaaatcagagatcaccttgctcagaccagcccaatcgaaaaactgagatcgtattgccggattcttcaatgcctgcatgtaaatctccgtccagcatccaggtaaatcgtcctgaaactctgagaggtccacaagcacaaactgaaggtaggctagcgttcgggtgaacgcaagacaaacttccaacaacaccgcgtcggctcggaaaggctgtatgacttccttaagtacactaaagatgctgttcttatacagcttctcggccacaccacttcgaattatgggggtgtggctttgatgacatactgtcgtgattgttgttagaccggcacataccttcacaatgtcctcgggggcaaaatactgtgttaggagccaggcacagtaaacggcgtgatatgcatcgttgacactcttcaggtagccagcatccagtcctgactcatgtttcctccctcgcttcttcaggcggcgcatgttctcctccacgtttaacttcatccagactatggtgtcccccgggtctgcggtaaacgtggccaaaacttgaataaagtcactataggagagaagctggctccggagcagcattagagggaaaaccacggaggccgacagcaaatggcgatcatgcaaaatccaacaatccaggggcgcgactgacctggcaccagactcggtaaccagcaagctccgcttcctagaggccaagactctgaaaggggtggtaaatttcatctggcatgctaaaacctcagccgacgtgtcttcccttccatgcctcgcccgagtcacattcttgtgcatggccttaatggcattttcatacacatgagtccagtaccgcatcggttcagggactacaatggtcaggtccccaaagacagccttcaaatgattcagcatagtagtctttcccacaccaggggcaccttccaaaaatagggaacaggcaggtttgattactggtacatgatttgttaggtgggtcacaattggaacccgcatgctctccttcctctgagccttggcctggcgggtgtcttgggcatcatccagattcagaacattcatcacactcccacttagccgcttcagctgggcagcatgcttggataacttactaaactcgcgcccatgggcggccaggtgttcgaagagaccagaaggcttacccttgccaccattcttttgttttaacgcggaatgagaagagggcctgcggaaattagactcatcctcagactcacagtcagatttgtcatcgagcccaaggccggccaggccctcctcaaagcctttctggtacatgaagctccggctcgtggagtccgcacctccttctgtgcacgaagttttgcggaaccaggagaaggggtctggcgtcttgctggggccacactcccggctacggggcttcggggtaggggcagtaggcttttggtgtgcgggtgctggtggctgggctcccctgggcagggtaaaggggcacgatgtgtgccggctacccggagagtttccagtattagatgtcacggcagcctgggtccggcacggcaccctctccccagacagtccggtcggagccatcaaggggggccagtgggtgggcacctggtagaggccgtcgtcatcttcctcacctgcccctgagtcactaccggttggggtaagaactgagggggcaaagtcatcaatctcagcgtaaaagttttcgtgtctttcgttttcaggggactcatcctcctgacattttcgccagccgccgggcgggccggcctcctttcctggaaatccagccatggatcccacccggggtctgtgtgccctctccacacacgacctggcaaaatttcacagtcttcccccggctagaaaggcggcaggtaagcgagcgcaccttcggtgttactccaagctgctctctcttaagagctgggagcaactggcctcttttttgtctctgcccccgggacccacgtttacagactttagactatttttcgaagtcaccctgggtcggagaatcgcagattgcgttgtggtagctctgcagccttatccccggtgttatattgtagaatttaagacggccatgagcaacacggccaacccgcaaagcgttactcgcaaggcacagaggctagagggcaccgcccagttgtgtgactgtgccaattttcttcgcacgtcctgcccccccgtgctgggcagtcagggcctggaagtcttggcggcgttggtatttaaaaaccagcgatccctgagaacgctccaggtagagtttccagccctgggccaaaagaccctccccacctccaccaccggcctgctaaacctcctctcccgctggcaggatggcgctctccgggcacgtcttgatagaccccgcccgactgcccagggacacaggccccgaactcatgtgggccccaagccttcgcaactcactgcgcgtgtcccccgaagcgctcgagctggcagagcgggaggccgaaagggccaggtcggagcggtgggacaggtgtgcccaggtgctcaaaaataggctgctccgcgtggagctggacggcatcatgcgtgaccacctggccagggcggaggagatccgccaggacctggatgctgtagtggccttctctgatggcctggagagcatgcaggtcaggtccccctccacgggagggcgctctgcgccagccccgccctccccatccccagcccagccgttcactcggctcaccgggaacgcccagtatgcagtctcaatctctcccacggacccccctctgatggtggccggcagcctggctcaaacgctgcttggtaatctgtacgggaacatcaaccagtgggtaccgtccttcggaccctggtacaggaccatgtcggctaatgccatgcagcggcgcgtgttccctaagcagctgaggggcaacctgaactttaccaactccgtctccctaaagctgatgacagaagtggtggcggtgcttgagggcaccacccaggactttttctcagacgtcaggcacctgccagacctccaggctgccctgatcctctcggtggcctacctgctactccaggggggctcctcacaccagcagcgccccctccctgcctcacgggaagagctgctggagctgggcccggagagcctagagaaaatcatcgccgacctcaaggccaagtcacccggcggaaattttatgattttaacaagcggaaacaaggaagcgcgccagtcaatagcccctctcaaccgacaggcggcatatccacccggcacattcgcggacaataagatttacaacctgtttgtgggagcgggactactgcccacgacggccgcgctgaacgtgcccggggcggcgggtcgggaccgggacctggtgtaccggatcgccaaccagatctttggggaggatgtgccccccttctcatctcaccagtggaacctgcgcgtaggtttagccgcactcgaggccctgatgctcgtctacacgctctgcgagaccgccaacctggccgaggcggccacccggcgtctacacctatcgtccctgctcccccaggcaatgcagcggcgcaagcctgccatggcgtcagctggtatgccgggcgcctatccagtccagacgcttttccgccacggggagctcttccgcttcatctgggcccactacgtgaggcccacggtggcggcagacccccaggcctccatcagctctcttttccccgggctggttttgctggccctggagctgaagttgatggatgggcaggctccctcccattatgccataaacctgaccggacaaaagtttgacaccctctttgagattatcaaccagaagcttttatttcacgacccggctgccatgctggcggcgcgcacacagctgcgtctagccttcgaggacggcgtcggtgttgccctggggcgcccctcgcccatgcttgcggcgcgggagatcctggagcgtcagttctcagcctcggatgactacgaccggctgtacttcctgacgctgggctacctggcctccccggtggccccaagctgagccagttcctcgcactggagtgggtcattggcaaaaaggtaaataaactcatcgcacgggggttttgcctccttctcgtctcttgtttcgggtaggggagtaaggccgctgccaggccgccatgctcagggccacggcgtgccagaggccctcgtagtcgtgcgcatccgagaggatggcacggtccagaagcagatagccggccaggcagaggaaggccacaaagagggggcgaaggcgtgcccgaacccgggtttcatgctcgtctgcaccccagtggacaaggcagtagaggacacccaccaccaggcggttagggaggacactgccaaggttgaagagcagatttccgtcagccagggtgacctggctcaggtccggcgccctgcgagtccaagctgcgcccacacacatgcacagacggcccctgtgacatcaggccggtcatgcaaaaacagacaaagagaccgtgagcggttaccggggcgcagggcctctgccgggaagcccacccgggccagggcccggtaaagcaggtaccagtattcatccggcaccttgcgtgccaacacacgattcgtgcggtttccagtatttatcacggcttcccgccacaggtaaaagttaacacttagggtcagcagcttggtcagggataggtgcaaaaacctgagctcgtcctcgcgcagagcgcaaagcggccagttctttagcatcttcaggaggagcccgtgaatcccaggtgtcattcgcgcgtcatccccgcgcacccccagtcccattaacatagcgggcacaatggtgcaggcaccgtctgtatacgtctgcggcttcgtggagcgcccggacgccccacccaaggacgcctgccttcacctggatcccctcaccgtcaagagccagctccctctgaagaagcccttgccactcacggtggaacacctgccggatgctccggtcggctcagtctttggcctttaccagagccgagcgggtctctttagcgcagcctcgattacctctggggacttcctgtccctgctggactcaatttaccacgattgcgatattgcacagagtcagcgcctgcccctccctcgagaacccaaggtggaggctctgcacgcctggctcccctcactgtcactggcctccctccacccagacataccccaaaccaccgcagatggaggcaagctgtccttctttgaccacgtgtctatctgtgccctgggtcgtcggcgcggcaccacggcagtctacggtacagaccttgcgtgggtcctgaagcactttagtgacctggaaccgtctatcgccgcccagattgagaatgacgccaatgccgcaaagcgtgaatccggatgcccggaagaccaccctctgcccctcacgaagctcatagctaaggcaatcgatgctggatttctgagaaaccgcgtggagactctgaggcaggacaggggtgtggccaatatcccagccgagtcgtatttaaaggccagcgacgccccggacctacaaaagccggacaaggcacttcagagcccaccaccggcctccacagacccagccaccatgctatcaggtaacgcaggagaaggagcaacagcctgcggaggttcggccgccgcgggccaggacctcatcagcgtcccccgcaacacctttatgacactgcttcagaccaacctggacaacaaaccgccgaggcagaccccgctaccctacgcggccccgctgccccccttttcccaccaggcaatagccaccgcgccttcctacggtcctggggccggagcggtcgccccggccggcggctactttacctccccaggaggttactacgccgggcccgcgggcggggacccgggtgccttcttggcgatggacgctcacacctaccacccccacccacacccccctccggcctactttggcttgccgggcctctttggcccccctccacccgtgcctccttactacggatcccacttgcgggcagactacgtccccgctccctcgcgatccaacaagcggaaaagagaccccgaggaggatgaagaaggcggggggctattcccgggggaggacgccaccctctaccgcaaggacatagcgggcctctccaagagtgtgaatgagttacagcacacgctacaggccctgcgccgggagacgctgtcctacggccacaccggagtcggatactgcccccagcagggcccctgctacacccactcggggccttacggatttcagcctcatcaaagctacgaagtgcccagatacgtccctcatccgcccccaccaccaacttctcaccaggcagctcaggcgcagcctccacccccgggcacacaggcccccgaagcccactgtgtggccgagtccacgatccctgaggcgggagcagccgggaactctggaccccgggaggacaccaaccctcagcagcccaccaccgagggccaccaccgcggaaagaaactggtgcaggcctctgcgtccggagtggctcagtctaaggagcccaccacccccaaggccaagtctgtgtcagcccacctcaagtccatcttttgcgaggaattgctgaataaacgcgtggcttgaaagtaaactttattgcgtgttagtacctgtccattcacaggggtatccagcccttgcgccgcctcccccagcccgccagccaccccagacaggagatgataatgatgaggagcaccggagccaccacagcacaagtgattaggagcagggcccagtgcacccaggtggtcttagggcgccagggatcgattggaaaagggcccagggtcactggcttatgcgtgggacgtttagaaacaggccgcctatggggcctgtgactggtgcttgtggtgtgggagactaatgtggtgggggctatggtagtggctgggataacagtaagatgcatacgctgagtgagggtccggttggcatggtattggtcgtcttcttcccctgcagagtaattgcagtggaccccggaggccacactgcaatttctcagtgtcacattgcacgtgtagtaacctgcatgcgcaagggtcacattggggattatcagagagacggaggtgttggagtcatttacccattctagggtaaggctataattgtaacccccgttagttatatgagttccgttgttggaagtagctacggccaagggcagttgtccatccccgggagtgtatccccggcccaactcgatccgagagaccgactcattgctaggaacgctgcaggtgagattcactctagcacctgcatgggcggtgacattttcaaatttaaccagatctgagaaaaatgcacaaacagaccccacacagcagcacaatagaagcactaaatgagtcattcctaaactgtcagttttaaaactccctgcttctcaggcctaaatatgtggtggggtgtgcttaggatcactttcatattctgcaacaacagccatacccggaagaggagctgccggttgccatttttcaagctgctaaaccacgagtggcagcaggcctaagaagctcctcagcaacatggagacctcgaagggaaactggcaggagcagggagtcacgtaggcactagcctcttcatgtgaggtaagagatcgctaaaaatgggatcagggtatgtaaaccgagttttgcgggggatggtgagccagacacggcgggtgggggaaggagctgacacgattgagtagaaagggccaaaaatacaccagctataaggaattgctcaggccaaagttgttcctcaggtggctttaggcctaatgtaggcaattgcgtgcctagaacattgctaatgtgccctgggtttcctgccttcatgcaaatattctacctcccccggcctggtgcaaaatgtctgcctcagaatactaacagctaatccaagctaacattctatcagtaaacgggcagaaaactgataaggaccgcggagtttggccctccgcggtgtccggtggtcctcacacgtgccctccccccgggccgatggctgaggcccggaatatgcaagtgcatctttctaaccagtaggggcctccacctaggtgctttgttaatctttagtgggaactagtgggagtgctgtgcctcgggtacccctatcctataggtcctaccggagctccttgtcttgataatccctgtaaacacacaccacctaagaacaaggcattgttaacctttggtggaacctagtgttagtgttgtgctgtaaataagtgtccagcgcaccactagtcaccaggtgtcaccggaggctacttgcctcagtgccacttttaccttctcaaatctatacggggggggggggggctctgtaacatttggtgggacctgatgctgctggtgtgctgtaaataagtgcctagcacatcacgtaggcaccaggtgtcaccagggctacttgcctcggcatctcctcaccggagaaggggttaacaaacccgtggggggtcttagtggaagtgacgtgctgtgaatacaggtccatagcaccgctatccactatgtctcgcccgggctatatgtcgccttacctcccctatatagtcacgaccccaccgaaccaggcatgatgtagaataaaattttatgcatcatcttctaatctgtgccgcttggagggaaacatgaccacctgaagtctgttaaccaggtcagtggttttgtttccttgatagagacacaaggactgccagccccattggggagggggggtgggtacgggagagtttgggctcgtttaaacaaagtctcatctgatgctctgtggcacctcaaggtgaatatagctgcccatcgacgtatcgctggaaaccggtgggccagggcctggccgcacgggccatcgatgcggatccagacatgataagatacattgatgagtttggacaaaccacaactagaatgcagtgaaaaaaatgctttatttgtgaaatttgtgatgctattgctttatttgtaaccattataagctgcaataaacaagttgcccgggcccgagtgcgtgggcatgacaatcgtgccctggggaccaacacaatccagaagggcctgaatcactgcgaccggccctcccgcgacccagccgagcgagcttagcgaactgtggacgagaactgtgccaccaagcgtaaggccgttctctcgcatttgccttgctaggctcgcgcgagttgctggctgaggcgttctcgaaatcagctcttgttcggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtggagggcccccccgcagatctgagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccaagcttctcgacagcgacacacttgcatcggatgcagcccggttcgcgttaagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatcagttatctagatccggtggatcccgggcccgcggtaccgtcgactgcagaattcgaagcttgagctcgagatctgagtccggacttgtacagctcgtccatgccgagagtgatcccggcggcggtcacgaactccagcaggaccatgtgatcgcgcttctcgttggggtctttgctcagggcggactgggtgctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcggctgaagcactgcacgccgtaggtcagggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcaccatggtggcgaccggtagcgctagcggatctgacggttcactaaaccagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaaacgtgccggcacggcctgggtaaccaggtattttgtccacataaccgtgcgcaaaatgttgtggataagcaggacacagcagcaatccacagcaggcatacaaccgcacaccgaggttactccgttctacaggttacgacgacatgtcaatacttgcccttgacaggcattgatggaatcgtagtctcacgctgatagtctgatcgacaatacaagtgggaccgtggtcccagaccgataatcagaccgacaacacgagtgggatcgtggtcccagactaataatcagaccgacgatacgagtgggaccgtggtcccagactaataatcagaccgacgatacgagtgggaccgtggttccagactaataatcagaccgacgatacgagtgggaccgtggtcccagactaataatcagaccgacgatacgagtgggaccatggtcccagactaataatcagaccgacgatacgagtgggaccgtggtcccagtctgattatcagaccgacgatacgagtgggaccgtggtcccagactaataatcagaccgacgatacgagtgggaccgtggtcccagactaataatcagaccgacgatacgagtgggaccgtggtcccagtctgattatcagaccgacgatacaagtggaacagtgggcccagagagaatattcaggccagttatgctttctggcctgtaacaaaggacattaagtaaagacagataaacgtagactaaaacgtggtcgcatcagggtgctggcttttcaagttccttaagaatggcctcaattttctctatacactcagttggaacacgagacctgtccaggttaagcaccattttatcgcccttatacaatactgtcgctccaggagcaaactgatgtcgtgagcttaaactagttcttgatgcagatgacgttttaagcacagaagttaaaagagtgataacttcttcagcttcaaatatcaccccagcttttttctgctcatgaaggttagatgcctgctgcttaagtaattcctctttatctgtaaaggctttttgaagtgcatcacctgaccgggcagatagttcaccggggtgagaaaaaagagcaacaactgatttaggcaatttggcggtgttgatacagcgggtaataatcttacgtgaaatattttccgcatcagccagcgcagaaatatttccagcaaattcattctgcaatcggcttgcataacgctgaccacgttcataagcacttgttgggcgataatcgttacccaatctggataatgcagccatctgctcatcatccagctcgccaaccagaacacgataatcactttcggtaagtgcagcagctttacgacggcgactcccatcggcaatttctatgacaccagatactcttcgaccgaacgccggtgtctgttgaccagtcagtagaaaagaagggatgagatcatccagtgcgtcctcagtaagcagctcctggtcacgttcattacctgaccatacccgagaggtcttctcaacactatcaccccggagcacttcaagagtaaacttcacatcccgaccacatacaggcaaagtaatggcattaccgcgagccattactcctacgcgcgcaattaacgaatccaccatcggggcagctggtgtcgataacgaagtatcttcaaccggttgagtattgagcgtatgttttggaataacaggcgcacgcttcattatctaatctcccagcgtggtttaatcagacgatcgaaaatttcattgcagacaggttcccaaatagaaagagcatttctccaggcaccagttgaagagcgttgatcaatggcctgttcaaaaacagttctcatccggatctgacctttaccaacttcatccgtttcacgtacaacattttttagaaccatgcttccccaggcatcccgaatttgctcctccatccacggggactgagagccattactattgctgtatttggtaagcaaaatacgtacatcaggctcgaaccctttaagatcaacgttcttgagcagatcacgaagcatatcgaaaaactgcagtgcggaggtgtagtcaaacaactcagcaggcgtgggaacaatcagcacatcagcagcacatacgacattaatcgtgccgatacccaggttaggcgcgctgtcaataactatgacatcatagtcatgagcaacagtttcaatggccagtcggagcatcaggtgtggatcggtgggcagtttaccttcatcaaatttgcccattaactcagtttcaatacggtgcagagccagacaggaaggaataatgtcaagccccggccagcaagtgggctttattgcataagtgacatcgtccttttccccaagatagaaaggcaggagagtgtcttctgcatgaatatgaagatctggtacccatccgtgatacattgaggctgttccctgggggtcgttaccttccacgagcaaaacacgtagccccttcagagccagatcctgagcaagatgaacagaaactgaggttttgtaaacgccacctttatgggcagcaaccccgatcaccggtggaaatacgtcttcagcacgtcgcaatcgcgtaccaaacacatcacgcatatgattaatttgttcaattgtataaccaacacgttgctcaacccgtcctcgaatttccatatccgggtgcggtagtcgccctgctttctcggcatctctgatagcctgagaagaaaccccaactaaatccgctgcttcacctattctccagcgccgggttattttcctcgcttccgggctgtcatcattaaactgtgcaatggcgatagccttcgtcatttcatgaccagcgtttatgcactggttaagtgtttccatgagtttcattctgaacatcctttaatcattgctttgcgtttttttattaaatcttgcaatttactgcaaagcaacaacaaaatcgcaaagtcatcaaaaaaccgcaaagttgtttaaaataagagcaacactacaaaaggagataagaagagcacatacctcagtcacttattatcactagcgctcgccgcagccgtgtaaccgagcatagcgagcgaactggcgaggaagcaaagaagaactgttctgtcagatagctcttacgctcagcgcaagaagaaatatccaccgtgggaaaaactccaggtagaggtacacacgcggatagccaattcagagtaataaactgtgataatcaaccctcatcaatgatgacgaactaacccccgatatcaggtcacatgacgaagggaaagagaaggaaatcaactgtgacaaactgccctcaaatttggcttccttaaaaattacagttcaaaaagtatgagaaaatccatgcaggctgaaggaaacagcaaaactgtgacaaattaccctcagtaggtcagaacaaatgtgacgaaccaccctcaaatctgtgacagataaccctcagactatcctgtcgtcatggaagtgatatcgcggaaggaaaatacgatatgagtcgtctggcggcctttctttttctcaatgtatgagaggcgcattggagttctgctgttgatctcattaacacagacctgcaggaagcggcggcggaagtcaggcatacgctggtaactttgaggcagctggtaacgctctatgatccagtcgattttcagagagacgatgcctgagccatccggcttacgatactgacacagggattcgtataaacgcatggcatacggattggtgatttcttttgtttcactaagccgaaactgcgtaaaccggttctgtaacccgataaagaagggaatgagatatgggttgatatgtacactgtaaagccctctggatggactgtgcgcacgtttgataaaccaaggaaaagattcatagcctttttcatcgccggcatcctcttcagggcgataaaaaaccacttccttccccgcgaaactcttcaatgcctgccgtatatccttactggcttccgcagaggtcaatccgaatatttcagcatatttagcaacatggatctcgcagataccgtcatgttcctgtagggtgccatcagattttctgatctggtcaacgaacagatacagcatacgtttttgatcccgggagagactatatgccgcctcagtgaggtcgtttgactggacgattcgcgggctatttttacgtttcttgtgattgataaccgctgtttccgccatgacagatccatgtgaagtgtgacaagtttttagattgtcacactaaataaaaaagagtcaataagcagggataactttgtgaaaaaacagcttcttctgagggcaatttgtcacagggttaagggcaatttgtcacagacaggactgtcatttgagggtgatttgtcacactgaaagggcaatttgtcacaacaccttctctagaaccagcatggataaaggcctacaaggcgctctaaaaaagaagatctaaaaactataaaaaaaataattataaaaatatccccgtggataagtggataaccccaagggaagttttttcaggcatcgtgtgtaagcagaatatataagtgctgttccctggtgcttcctcgctcactcgagggcttcgccgtcgctcgactgcggcgagcctactggctgtaaaaggacagaccacatcatggttctgtgttcattaggttgttctgtccattgctgacataatccgctccacttcaacgtaacaccgcacgaagatttctattgttcctgaaggcatattcaaatcgttttcgttaccgcttgcaggcatcatgacagaacactacttcctataaacgctacacaggctcctgagattaataatgcggatctctacgataatgggagattttcccgactgtttcgttcgcttctcagtggataacagccagcttctctgtttaacagacaaaaacagcatatccactcagttccacatttccatataaaggccaaggcatttattctcaggataattgtttcagcatcgcaaccgcatcagactccggcatcgcaaactgcacccggtgccgggcagccacatccagcgcaaaaaccttcgtgtagacttccgttgaactgatggacttatgtcccatcaggctttgcagaactttcagcggtataccggcatacagcatgtgcatcgcataggaatggcggaacgtatgtggtgtgaccggaacagagaacgtcacaccgtcagcagcagcggcggcaaccgcctccccaatccaggtcctgaccgttctgtccgtcacttcccagatccgcgctttctctgtccttcctgtgcgacggttacgccgctccatgagcttatcgcgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacatgagaatggtcgagttaaacatgcatccttaaggccgagacgggcagccggagcttgtggtactgtccctccggcaggtggagtgggacacagttagagaacattagtcctctggtccctatctccacccgccaggcctgtgtgtcagtttgcagggccatcctcgcactcaggtggactggctaggcacccttctgaagtatctggcggtgactgtcacctggttcttgagagagtccataaaatggctgaagctccaggcgtatagtataatgagcaacagggccaaacaggcggcggggcctgggtagtagcgggcaacgagagactctgtgcaatcaaaccccaggctcccggcctcacccaggaagagcagcggcagggacagcataaaccaggagaaggcgcaaatgagtccggtgaaggtgacgttgcatatcaggcgcggcttccttccgaattttgtgcgcaaaagtttccagatgatgataactgtgaggaggacgatcaggactgccgccagtaggtagcagccggctttcagtccttggacggccgtgtgcatgcctttggtggggccttccctgcacatgttggggcctctgttgagattggcgtcggggcccatggtaatgaggaggatgataatcagcaggagtaccagacaaaacacgcccatcaggtacaggcacacatttctgtgggaggttctcttgggcgttcggctgaacaatgctagggtcttctccaacgccatacccaagtgagtccatacggagcacatcaggcccaagaacatcatgttctgggtcaaaaggcagagaccggtagacgagaactcctgaatcatttttcccagcacccagagcagcagttctatgagaagagctatcagccagacatccattcggtgaaccaattttcttacaaagatgataaacaagatgccagccagtgttagcagaatcagcaggacgagcagcaggcttgtcatgccgctgaggaaggcgctgtaggatttagtgcacgcatcttccgttgcattgacggaagtcatgttggccaccagggtccccacggtggacccgggggccatggtggagagcatcttgctggtcagagccagactgggtggtgtctgcagcaaaagaggaacttgcccaggcagtcagttattttgcatgccacctccctgcctggtggacttccagactattttctgcattcgcccttgcgtgtccattgttgcaaggagcgatttggagaaaataaactgtgagtttcacagatccacgggccacgctcccctgggggcttcatgatcccaccgcctttcccgatgatgatgacaaccgcggctgtctgaagcggctgacgaaatcggttgagattctgatgagaggcttgggggggtctttgccctcaaggcgaggctccttctcctaggaatgccgagccccctgcactagcttcgctccactggggatctttgccagccttcatactagattcagcgatcccccggttgggaatcttcgccagccccccgtcctgctatcccgctcgtcgccgcgcctcccatgctaagggcccccttcctttcccttgactttggggatattcggagtctgctctcgccgctctcttctctcgtttaaacgagagaatagtagtagggtccagtctcaggccccctcactttgggtcttagaatggtggccgggctgtaaaattctggaggacggagagggcggccccggagttgttatcaaagaggcactggaggatgttggccgctccttggagcagcttgtcgaaataatgatccacggccacgggaacgccgtgccgctcggcgtaggccgggtcctcggccatctccgtctttctcgcccccttcactccccccttgggctccacaaagacgtactggatgcggtcgtggatctggggcagttcctcgttgcgctcgacgaacttctggtagacggccaggtgaggcatctgggtgctcttgtaggctgagagcttgcggctgagctccgttgaaaagcagagctcccccatggggaccctgccttcacggaggtctgtgtaggcctggtttaggatgtcaatgacgggcaaaaagcccacaggtagcccttgtgtaaatgactcttggaagggccggtgggagaggaggctggccgcctcctttacccgggcatccgccagcaccaggtcgagcacgcgccggcagcgtgtctgcacaaacttgcaggccgtcttccggacgagctccacccccttcatcagggtcttgccgtccgtcagcacccccacatatctcttctttgtaatcagcatcaggcaggagaaggtcttctcggcctccagggagatgggggccacaaacaggctccgggtggtgtgggcggccagggcatcggcaaagcgcagggtctcgctctctgaaaacccccggcactcgataaacagcgagtccgtgtccccgtagatgactcgaagctggccctcggggttgaggggcgcccaggcgtccggggagggggccagggcctgcaggttggcggggctcagggcctccacgaaggccttggcccgctccaacatcgtgcggccctgcagcgtcaccgtctcggcgatggagaggcagggaaagaggccgttggccaccccggtgaagccgtagacggcgttgcacgtgcacttgatggccagctgctgcttgtcgaggatggtcctttggcgcggatcctcgcaggccgccagcagcttcttgatggccttgcgcttggccagccaggaggtcaacagactagccaagaaggactcgtgcacgtgcttctttacaaagtggtagacgccccccgtgagcctgaaggactcatagtcttctcccgggcgcaggccggctagcctgtgctcttctcccggcgttatcatggtagaataacagagattatgagcctgaatgatgctcgggtagaggctggcaaagtccaccaccagaaccggggagttgtagaatccggacaggggctggatgacggtggccccctggtagccgtcccggtcagaggccgagggcatgggcaggataaagttttccttttgggcggccgccaggaggcaggagaacacgcggatctgctgcccatcgtccagcacccgcctgcaggggatgtgagcgatcttggcaatctctgccacctccacgtggatcacgaaatggtttagcagatccatgaccagggccgagtcctgcacgcagtacatgccgagccgcctgcgcccctcggggcccgctgcaaagaggcgaggaatctccttgtaatgcacatcctccttcttggcccccagtaggtgcctggctactgtgtccagcttgtagtctgagaggctgagcttgtcccggcacacggcgtacatgtcgatggggatgaggccggtgatgcggaccttggtgttggcccgcaagaagcccttgcccgcatcatggggtcgcctgacctcgcagacgcccccagccctaattttgcccagagaggctgggttgatgctgtagatgtgcctggctctgtccagaatgtagggccagtcaaagttggccacgttgtagccggtcacaatctccacgctgaggtctctgatgagctggaagaaggcgtagagcatgtccagctccgatgggaactcgtagacctcaaccccctctatgtcttcgcaggtgcccagcgtcagcaggatgcgcctatagcgcccggcctcctcccctgtcgaccagaggacgcaggatatctgcaggatcaggtcagcctcgttggtggccgtggggaagccctcctcccccagacactcgatatcgaaggccagggcctggtaggagggccaggagctgtcttcacgccggaccgagaggtcgcccacctcacagtcgtactcgagctcggcgtacgagtcccggtgctggaggcgggggatggcgcggcggcagctgtaccagccaaaggtgacaaagtcattgtccaggacaaagcggcgcgtggcatccacgttggcctcaaagatccgacacccgtgcttgtcttgcagccacgtggccacgtgacacacactgttgggatgggagagggtgatcttgtggtagtcgccggcatggttgccgtagcccataatggaacggcgcgtgaccttctccaccgagacccggcagggggtcctgcggtcgaaggtgctggccttgagggcgctgaggactgcaaactccacgtccagaccctgaggcgcgctggcgtagaagtaggcctgctgcccaaacacgttcacacacacgctggccccatcggccttgcgccggcccagtagcttgatgacgatgccacatggcaccacatacccctgtttatccgatggaatgacggcgcatttctcgtgcgtgtacaccgtctcgagtatgtcgtagacatggaagtccagagggcttccgtgggtgtctgcctccggccttgccgtgccctcttgggcacgctggcgccaccacatgccctttccatcctcgtcaccccccaccaccgtcagggagtcttggtagaagcacagggggggctgaggcccccgcacatccaccacccctgcggcgcctggtgtctggaaacacttgggaatgagacgcaggtactccttgtcaggctttttcagaaggcctttattaggtcttaggaaagggttatagaagagtcccccagacatggttaaaactcagtctctgcctccccaagcagtgcggcggcggtctctggatcgtgatagcgtcttctgcgtaggcctggaaaacggtccctggctgcctgcaatgctctgctggccactgagggtccggccgccctctgagctgctctcttttgctcctggttttgctcatgcagcgctaacatgatggcttgtaattctgtcttactaatgggattaatgcctggaccctcaccagaggcatgttgctgagcgagctcgtcgatcccggggtagagcatctgcaccggctgctgcgacatctggcgcgtgcgcctcgtgagggaaataaccaggatcaccacccccgccaccaggaccagaatgagcatgccgccgaaggggtttttgaagaaggagatgaaaccagagaccaggctgctaaacaaaccccccaccgtgctgactaggttggtgatggactgacccacgctacccagactgtccataagttcccccaggccgtccacgaattgatttcttccgtttgacactgcattgtccaaatccttccgcaggccggcgatgttttgcgcctggaagttgtactcccggaagatgccctccaggtcaaagacgttggaggcacgctgttcgtcccgtgagtacagctccagggaggcaaagtcaatgttctcgatgagggaggtgtttagtgagatgaaggtctgcagggtggcaatgccgtccagctcgatggttttaaagtggtggtagtcgttgtagacgtggatctcgttgccggactggaagtagtactggctggtcgcctggcacacctccgtcatcttttttgtgaggaagatctcgttgtcggtgcccagctgtccctcgtaggtcttggtgtcgttgataaagctgaaggacaccagggggcgcgagtagcacatggtctcggagccagggaccctcatgctcttgcgcagggtgacggtggcctggttaacgggcacgcactgggagactgagatgacatcccccaggcgcttggccgccaccgccttaccgtagatgctggacatgacggtggttggattaatcttggttagttctctcagcaccatgttctgcctcttctgctccaggcaccaggcccgcgcaaggtctcccagcatgcggttgatctggcggcgcagggagtcgtaggcaaattggatctggacggtggcgggattgttgagggtgcccagggacttcccgggggccgtggggggcaccggtgtggtggcgttccccgcatcccgcctccgacgcctcagaacggcggcgggggtgctcccgcgggccgcggatggggctgggggcgatggactgctggggggtgaggaagtcggagtggtaagctccgtcaggttcttgacggtggccaacgagcgcggggtcagaggtagccaagctaataacaatcctccgctcgttataaaatatgtaatggcttcctggcccttcgtgtaacgatcctggacggcctcgtacttctcatgcatggtcttgttcacctgctcttcgatgcacttgaaggcgtccgggagctctatgcccacggttgtgttggtcacgaagctagaggtgccctcgtcagtcacaaaatgtattgacttccctgtttctgtggcgatggtcgagtcaaaggtttgccagtgttgaagcgggcagtaggctgtcctgttctcgagcttccaagatagcgtgtaagtgcccttgtccaggaaggctcggcgttcgccttgcgggttcgtccctcggttgtcgtagtccactatcttgtagttagttctcacgtggaaggagtctgcccgctcatggaaggtttccttatttttcccgtcatagaaaggggacatttccacagtctgcccggtggtggtcacaaagaagtcgaaggggctgttggacttggccatcatgtcagttatcaggcagttgacggtagttcttgttctgtaagtccatatcaaccacccgggggcgtcatagagctccgtctggctggcgtagcggcgcaccccgttggccaggcccccggtgggctttaggttgacggtgatgttaactccgtcgcggtctacatacacgcgcgtcagcccatcttttgtcatcttgaccgcgttgtagcactggtagatggtatccatctggtcagtttcgtagctgtcaacggagaacttctcctcgtgccggttggtcacggagtccgcgtaccagccattgtagatgagaatgttggtcactatcttggtgtaggagcggaccttaaacgagtagggaataatgttgtctttaaacaccatcaacaggccctccgtgtgattctcccgcgtgccaaacgagggacactggatgtccgaggagaagcggaacaggtcgccgtggctggagagctcgcagactcggaaaggaaagctggtttgctgacgcgtggcggtaggctgcaccgtggtggcggggggtgcgggctgctctggggtctgcgcaccgagacggcacgccagggcggctagcagcacgaccacgcttagcaccctacgccgagtcatctctcatttggaggtgcaggtagagaagggcatatagatccttaaatacccaccccctgcccttatacagaagaattagggggcggtcagagtcgtacgtgaggtaaagcccatccgggggcagggcctggccggggctgaccgcgtccgcccggcgcaggatcaaggaccgcccccaggtcttgttgtagagggacacggttaggacggcctcgcgcagcgcccggcacagaatttgctggctagatgccagtgagcccccgggtacgctgtagaagctgttgaaggaggtctctatccagtcgctcggctcgatgcctggccatatcagggaagtcaggaatgccttctggtggggcagcgtacctgcggcgtcacagcagcgagccagggccacgttgctgggtgggggaaagagcccgctctcctccgccaggggccccgtgatgaaggtgtacaggctgtgcgtcagcgcgtgcaggtgctccgagctcagggtctgggtaaacaggtgtgttttgatgtacttggaattctcaaaggcggcaccctcgccggcgcgcctgtcctcccagggacccgagacgaaggcccgtctgtagaggaagtggttgcgcatgcgggccagctcccagtagaccacgtccccccagacgcgcaggcacagggtctcggtcagggtctcgctctgttgcgccaggcaggactgcagcttggccagaccctcggtggccacctggcgcaggtactgctccttgcgcttgagcgcgtccgagagggcgccggacgggccgggctctcgtgccccagccggccggggcacctccgggctctcccgggacgcctcctcctcgcctcggcccaaccgctgcatggctcggttgagccgcgtgtacagctcgttcctcttttgcaggatggcccggtactgggggtgcgccgtgaaggcggcggcgcagtccgccttcagcgcctccaccgcgtcgcccgaggagctgtagaccccgccgcagaagagccgctccgtggccccgggagccacggcgtcaaacaggtgagtcagccttgcccccgccagcgcctcctcgcaggccccccgcaccagggccaggcgacgctcccgggcaaacagggcagagaggcgggaatggccgccaccctccccctgccccgttgcaccgatagcatggccgccagagttccaatagaggagctccgagagctccgccacctccgggggcactgtcgagaagacgttgtaggtgtccagcgctctggtcgccccctctgcctccggccgccccgggcccgggaccgcgccctcctctgggccgcccggcctcgccttctcctcagcctccaacaggtgcccgagccccgcctggcggacttcattctcaaacagtcccgagaccggctccggattcaccggcaccgccaggtggttacaggagacgtgggtcccctctgccgtggaagggttgccgtggttgggcagaaccatcagctcgcccacacagcgccagcagggcacagaggtgatgtagaggcgcgggtctgggatgggacttacgccccgaaagcggcccagcagatccagggcccgttccaggctctccagccccatggtgtgagacatgcaataaaacacgctattgattctcttcattaaaatctctatgtcatttattaggcacaaacttacatcgactttatgccccccgtaaaactccacagagtacgcgactgagggggtacggagaggcgggacccgggtaccctttctaccaggggcgagcagcgcggcagaggcctctctcgagttctctagcaggtgcaccagctccagggacagggcgctgcatgcacggtcattctgccgtctcaaacggggaaggaggatggcctccagctcggccagcaggccggcgttgcgcaccaccgcagccacgtccagactccgggggtccagccgggtgcacacgctcagctcaaccgccagggcgtacacctggctgtacgccgccgccagcagccccgacatcgccgccccaggggtctctagacctcgagtccggggagaacggtggccagacggcgcttgcgtctgcccccggagccctgccctcctccacccagcagcagcccggccgaggcctgcgacgcggtgctgaccggctcggccacgctgataaagttgtcctgggctgccccgggcccaccccacactccctccagaaagtcccgagcggcctccgccgtccactctatcccgctggaggcaatggtcgccagggtttctaggacgctgtccgccaggacggagaagcggcccaataagtactccgcgtcgtccctagtcagcgaggcgcatgcctcgcccatggcatccacaaggttgcacaccacatcaaacacacagtcttcctcctgtttttgtgatataatggcctccaggccagccctgatgttctcaatctcatatgtggtcgcggcttgggtccggcgcttcacggtcaaccctagggtgggggtggcaaagacaaacttcttccgcatggaagagcccccggcctgcttgcgcagcccagccccgggggcctgcagcaggttcctgtccacgccccggcccataaagtatcccaggttcccggcctggaatatctggttgttgccgttgacccccgtgtacttgttgatggtcactggcagcgtgacaaccggacgggccttgcagacctggctaagacagtctgtggccgcgcagaccaccgtggtcgcagtaagggaggaggtggcctccgcgtaggccgctgccgactccaccgcccgcgtgcccagtacgtgggggtagtcacgggcgggcaccgactgcgtcctcggcaccagtccctgaatcaggctgatgtagaactgggtctggccgcacgccttcaggatggcgttgttgagcctctgcttggcgtaagtgaccaggttgccaggcaccacatctatgacgttgctctcttcgtgggcccgggagcccccgtccacaaagagggccaggtcagagtactcctccgcgctggccccgctggggacagggaccgagcgccgcctggaaaagttgtgccacaggtacaggcttgagagcttagtgtccgggaatagggtcttgtggtaggtgttgaggaatttcatgtagggcccgttgatgatgtagttctccctcctggtagtggacttgatgaagctgttctggagggcggcattctcccccgtgaagaccaccctgttcttgatcttgatgttcctggggcacagcatcagcaccttggacatgcgcacaggcagccgccggccgtacacccggccctgcagggccgcgtccaggtctggcaggtcgcaggtgggctccccatgcaccaccttggcctccttggccgtgaggacccccttgtcgatggccaggctcctaaagttggtgcacagcgtctggtagtgaccctttagccactctggggggctctggccaagcccggggttgtcattctcatagcacatacagatgggcagggagatgtcctgcaggatggtcagcagtgagcggtaaaacagctgggtgaagatggggcaggcgggctgcgcaaaggggttgcacgagtactgcatcacgtggtagcagctcttgaccaggtccttgtaggtgatgttgttcttggccatgctgttcataaactggaccacttcggcgtccaccgccgcatccacgtccttgaacatcttgacaaagtcacgcgggccatggggctccttctctagctttccttcagcgtctatgcccagccgagacagccgctccagcaggttctggttcagctgccagtaggtgtagcggggctcgtcgtccggccgctgcccgtcgtcctccttatcgatgaagttgagaaagttgcccaaaaagtccgtctcgttgtaggagcccgaggcccccgagatcacataggggtccctccgctgcgtggacatgacgggggggaagcggtccctcagcctaaagaagagcgtgttcaggcacacggccggggcccggccctcgcagagcgagcacatgggactggcggccgcccccgccacgtagctgcccgtctccggcaccggggtcagagagctcttctgtccctggcaaaactgcaggtagtaggcatagcgggcaagaaggttgggcgagaaggaggccgcatagaccaggtgctccacagcgtagtttcccggaccgttggttccggtcacgtctggcccaccccagcccgagaagcagggtcggcggcaggggtcccaggtcccctcctgcagggtccccaggccgtgggtcatgtagaaactgttaaagagactctccttgccctgaccggttgacttcgagacccccgagacgtagaggacggaattggtggcaaagatctgcgtggacacgtggggggccaggctggcattatatcggtgtaacgcagccacacgggcctctggaccctcacagtcggcaaacaggggccacgagtcgtagttgaggctggccggggtctcgtgcgaggcctccagcatggcgggtgcgtagctcaccgccagctcgcatgccgcgctgtccacaatcattaaggctcccgagtccgggtgactgatggttgaggctgggaactccttgaggggggccaccttggccaccttggcctggtcctgcaggctctgcttctccagcagctccaccagcttgcccacccgtcggacgcgcagcgcctgcgccagcccggtgtacagcgcctcgtgcatgcagcggctgaggtccgagttgtaaaactggcggagctggggcacgccctctgggaacacctccttgtcgtagagcgggaccctaacgctcgcagactgccccaccgctacctcctgttttaacgatggaatggccaccaggtttccgctgtagagtcgctccttgaaggcctcggttattgccaccgcccccaggtaggcagagggatctagcccttcggggaagaagtcccccggcttggagctttccctcggtagggcgctgtaggcgtcgtacccaaacacctccctggtctcgccacagagggcctcgagacccggcccctcaaagatggggggaaccatatgggcattgtggaacacgtagatgtccctgtgataggaggtagcgcgtaggagcccgcagttggggtcgggcctcctgtgcagagccttgacattgatgctgaagcccggctccacggtgatgccgcaaaggagcggcaccgtcaggcacctgtggcccgcgtagccggtccccagtgtggccacctccctaagagggtaggtggccagggggtaaaagtagatgtagccgcacggacccggctggctctggctgcccagattatcctcgctagtctgtgcaccctgcatgatgcccaaggtatcgccccggcctcccagtcccacattaaatgttacactttactcatcacgcaacacccactgtttattcatttacaaagatttcaggaagtcagtcaggctggccagggcccacgtcacggggaactgacgtctcagcgatcttggcatgccgcccagcctcgcaaaccagagtctgcgatagagggccaggtagtgggcgattgcccccagcacgaaggcggcgctcttgtggtcatccaggtagtttcgcaccgcaaacaccactgtgtagcacagcaccaccctgagccgcgaccagtagtcgtagtggtcgttgtacactgcgcgcaggacgctgatgatgagccgtacgtgcgtgtctttgcccccgatgtcggctgtcctgcaggccagctccgcgtacagcttcctatccttcctcagggaggccttgatgagccggcagaggaccagggctggcaaaggcaggtctttctcatcccgggtgaacaccgcgtacatggccctgaacatgaggtagctggactcagccaccttgtcgtccggcggcgagggcgcgacccacgcctcgaccggggtcctcacaaacacagaatctgtagacttggctggcctcatggtctcgtcaggccagctcacgggcttcaggcttatatgataaaatgggcgtggcagaatagtataagacgcgaggcctgggtgaggagagtccagagcaatggccaggttcatcgctcagctcctcctgttggcctcctgtgtggccgccggccaggctgtcaccgctttcttgggtgagcgagtcaccctgacctcctactggaggagggtgagcctcggtccagagattgaggtcagctggtttaaactgggcccaggagaggagcaggtgcttattgggcgcatgcaccacgatgtcatctttatagagtggcctttcaggggcttctttgatatccacagaagtgccaacaccttctttttagtagtcaccgctgccaacatctcccatgacggcaactacctgtgccgcatgaaactgggcgagaccgaggtcaccaagcaggaacacctgagcgtggtgaagcctctaacgctgtctgtccactccgaaaggtctcagttcccagacttctctgtccttactgtgacatgcaccgtgaatgcatttccccatccccacgtccagtggctcatgcccgagggcgtggagcccgcaccaactgcggcaaatggcggtgttatgaaggaaaaggatgggagcctctctgttgctgttgacctgtcacttcccaagccctggcacctgccagtgacctgcgttgggaaaaatgacaaggaggaagcccacggggtttatgtttctggatacttgtcgcaataaacgcacttgcctatttcaccttgttttagtgtggcattgggggggtggcattgcgggtggatagcctcgcgactcgtgggaaaatgggcggaagggcaccgtgggaaaatagttccaggtgacagcagcagtgtgtgaagattgtcacagctgctggtttggagaaaacgggggtgggcggtgatcagggagaacaattccccggggacacctgcacgagacccctgggctctcaggaactccgcccaggtcttgccaattggggtgatcctgtagcgccgcggtttcagcatcacaggttattttgcctgaagcttgctggggcgtaaatccctctcgccttgtttctcagagagcatttcaggccggttttgcagtcgctgctgcagctatggggtccctagaaatggtgccaatgggcgcgggtccccctagccccggcggggatccggatgggtacgatggcggaaacaactcccaatatccatctgcttctggctcttctgggaacacccccaccccaccgaacgatgaggaacgtgaatctaatgaagagcccccaccgccttatgaggacccatattggggcaatggcgaccgtcactcggactatcaaccactaggaacccaagatcaaagtctgtacttgggattgcaacacgacgggaatgacgggctccctccccctccctactctccacgggatgactcatctcaacacatatacgaagaagcgggcagaggaaggtaagagtgccatctatctgtacttttatttattgcatcacaagtcacatcaataataagggcgccatctagcgggagatgttatccacaccatcccaattcacatctcagggacaacaggtcaaagttctttgttgacacccccagcgctggctccagggggtggaagcgttggatgcagtcctccgcatcggggcggacgcctcctcccaacgcgtttctgcggatcagtcgctggctggtgggcatcggagtcggtgggcggtcctccacggggacacgctccttcttggccttgttctttgaccttttggacattcttctgaaggaacggcggagagtagcgtagaatccagccagtggtctacccggtcgcatggtggcttcttagatgaggagcaggcataaaagtccaaacaggacacagagtaccaccaggagtagtcttagtctgctgacgtctgggtcctcggggcaggggtggctaggcctggtctccgtagaagagccgggcaggccgcaggcagaggactgctgctctagcaaagcacgctccaggacgtgtaccatctcgagagtgaggcacagctgttttcgtggacttttatacagtaaggacaaggaaagaaggccagaggaatgtggaaagatgagcgaggacaggtgtggaggttttgggctagctcttagtttctgggtgtgagagagggattaaagtgcttatgcgcaaagaatgtgtcaacaacaggtgttcctgcctctgctggcatgagttaggtgtggcttgggctgaatccaaatgtgtattggcacaagatggaaagcaaagttgctggagttactgggtgggagacagggatgtatgtggtcccccgctggtatgccagtaccctgtggaagtaaggggcctcatctgcctggtagttgtgttgtgcagaggtctgatgtgtgtaggaggggtgggttcaacgcaggggcgttggtggcggagtctggcaacgcccgggtccttgctacctgtgtggtgtgttaagggctgggtaaaggtgtctgccaattctcgcatgtcctcctttccccttgttttgaaatagaatatgaatgtggcttttcagcctagacagacagtgtggctaagggagtgtgtgccagttaaggtgattagctaaggcattcccagtaaatggagggagagtcagtcaggcaagcctatgacatggtaatgcctagaagtaaagaaaggttagtcatagtagcttagctgaactgggccgtgggggtcgtcatcatctccaccggaaccagaagaacccaaaagcagcgtaggaaggtgtggatcaccgccgccatggccggaatcatgactatgaccgccgcctccgtctgtcatcaaaggcgggccctggtcacctcctttgttttcaacctcttccgtcaattgtggagggcctccatcatttccagcagagtcgctagggctatgaggcagcgggtcatgtgggccattgtcatcagtgttgtcagggtcctgtgggccattgtcatcagtgttgtcagggtcctgaggcagcgggtcatgtgggccattgtcatcagtgttgtcagggtcctgtgggccattgtcatcagtgttgtcagggtcctgtgggccattgtcaggaccacctccaggtgcgcctaggttttgagagcagagtgggggtccgtcgccggctccactcacgagcaggtggtgtctgccctcgttggagttagagtcagattcatggccagaatcatcggtagcttgttgagggtgcgggagggagtcatcgtggtggtgttcatcactgtgtcgttgtccatggtaatacatccagattaaaatcgccagaaacaggaggagccaaaggagatcaaccaatagagtccaccagttttgttgtagatagagagcaataatgagcaggatgaggtctaggaagaaggctaggaagaaggccaaaagctgccagatggtggcaccaagtcgccagagcatctccaataagtagatccagatacctaagactgcgttgaaaaaagagtgttagggttggaaaagtgggggtgtggtaaataattcctagggaatgttagatcttaccaagtaagcacccgaagatgaacagcacaattccaaggaacaatgcctgtccgtgcaaattccagagagcgatgagcaggagggtgactggggaaagaggagaaagtgcgttagagaaggaagagtaagggaaagggggtgtggggcaaagggtgtaatacttactcatcagtaggagtatacaaagggctccaagtggacagagaaggtctcttctgaagataaagatgatcaaaattataattataagcatgagagcaaaggaatagaggacaaggagggctcctccagtccagtcactcataacgatgtacagccaaaacagtagcgccaagaggaggagaaggagagcaaggcctagggaagaggagagggggggtcctcgagggggccgtcgcgggcccggtgggcccctctcaaggtcgtgttccatcctcagggcagtgtgtcaggagcaaggcagttgaggaaagaagggggcagagcagtgtgagaggcttatgtagggcggctacgtcagagtaacgcgtgtttcttgggatgtaggcccggggggatttgcggggtctgccggaggcagtacgggtacagatttcccgaaagcggcggtgtgtgtgtgcatgtaagcgtagaaaggggaagtagaaagcgtgtgtttgtgttagaaaagcgggtccccggggggcaagctgtgggaatgcggtggccaagtgcaacaggaaatggaaaggcagtgcggcaatcagaagggggagtgcgtagtgttgtgggaagcggcagtgtaatctgcacaaagaggcgcggggcgcgcaacgttgggaggtcgttggcggcaggcgggaggccgtgctttaggggggttcaggtgaggcaaggctgtggggtaaccgtaggggaggcgggtgaggcggctaagagggctaagggtcggcgggtgacgaagcagcagacggcggatatgggaatttcagaatgaggtggcggattcaggcgaaaagggtgtgggctgtgcgagtgtcatgaggcaggcgcggaaagtcgctgcggcttgctggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccgtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcgggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcgggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggggtgttggcgggggcatgggggggtcggatttcgcccttattgccctgttt

SEQ ID NO: 28 - DNA, 183796 bp, Epstein-Barr-Virus (EBV)
agaattcgtcttgctctattcacccttacttttcttcttgcccgttctctttcttagtatgaatccagtatgcctgcctgtaattgttgcgccctacctcttttggctggcggctattgccgcctcgtgtttcacggcctcagttagtaccgttgtgaccgccaccggcttggccctctcacttctactcttggcagcagtggccagctcatatgccgctgcacaaaggaaactgctgacaccggtgacagtgcttactgcggttgtcacttgtgagtacacacgcaccatttacaatgcatgatgttcgtgagattgatctgtctctaacagttcacttcctctgcttttctcctcagtctttgcaatttgcctaacatggaggattgaggacccaccttttaattctcttctgtttgcattgctggccgcagctggcggactacaaggcatttacggttagtgtgcctctgttatgaaatgcaggtttgacttcatatgtatgccttggcatgacgtcaactttacttttatttcagttctggtgatgcttgtgctcctgatactagcgtacagaaggagatggcgccgtttgactgtttgtggcggcatcatgtttttggcatgtgtacttgtcctcatcgtcgacgctgttttgcagctgagtcccctccttggagctgtaactgtggtttccatgacgctgctgctactggctttcgtcctctggctctcttcgccagggggcctaggtactcttggtgcagcccttttaacattggcagcaggtaagccacacgtgtgacattgcttgcctttttgccacatgttttctggacacaggactaaccatgccatctctgattatagctctggcactgctagcgtcactgattttgggcacacttaacttgactacaatgttccttctcatgctcctatggacacttggtaagttttcccttcctttaactcattacttgttcttttgtaatcgcagctctaacttggcatctcttttacagtggttctcctgatttgctcttcgtgctcttcatgtccactgagcaagatccttctggcacgactgttcctatatgctctcgcactcttgttgctagcctccgcgctaatcgctggtggcagtattttgcaaacaaacttcaagagtttaagcagcactgaatttatacccagtgagtatctatttgttactcctgtttagttgaagaaaacaagctattggattgtaacacacattttacgctttgttccttagatttgttctgcatgttattactgattgtcgctggcatactcttcattcttgctatcctgaccgaatggggcagtggaaatagaacatacggtccagtttttatgtgcctcggtggcctgctcaccatggtagccggcgctgtgtggctgacggtgatgtctaacacgcttttgtctgcctggattcttacagcaggattcctgattttcctcattggtaagtgtgacaccaacaggtgttgccttgttatgtcaccgttctgacacatgacttacatgggtttggcttttgtaggctttgccctctttggggtcattagatgctgccgctactgctgctactactgccttacactggaaagtgaggagcgcccaccgaccccatatcgcaacactgtataaaggtaagtattattaaattttagagacactatcacgtgtaacttgacgtgcaaggatggaagagaggggcagggaaacgcaaatgccggttgcccggtatgggggcccgtttattatggtaaggctcttcgggcaagatggagaggcaaacatacaggaggaaaggctatatgagctactctctgacccacgctccgcgctcggcctagacccggggcccctgattgctgagaacctgctgctagtggcgctgcgtggcaccaacaacgatcccaggcctcagcgtcaggagagggccagagaactggccctcgttggcattctactaggaaacggcgagcagggtgaacacttgggcacggagagtgccctggaggcctcaggcaacaactatgtgtatgcctacggaccagactggatggcaaggccttccacatggtccgcggaaatccagcaattcctgcgactcctgggcgccacgtacgtgcttcgcgtggagatgggcaggcagtttggcttcgaggtgcatagaagccggccctccttccgtcagttccaggccatcaatcaccttgtcctgtttgacaacgcccttcgcaagtacgattccggccaggtggcggcgggcttccagagggcccttctggtggccgggccagagaccgctgacacgaggccggacctccgcaagctgaatgagtgggtgtttggtggcagggctgctggtggcagacagctggccgacgagctaaagatcgtgtccgcgctgcgagacacttactcgggccacttggtccttcagcccacggagacccttgacacatggaaggtgttgagcagggacacacgaaccgctcatagtttggagcacggattcattcatgccgcggggaccatccaggccaactgcccacagctgtttatgagacgccagcaccccggcctctttcccttcgttaatgcaatagcatcatcgctgggctggtactaccagaccgccaccggccccggagcagatgccagggcggcggcccggcgccaacaggcctttcagaccagggcggcggctgaatgccatgccaaaagcggggtgccggtcgtggccggcttctacaggaccatcaacgccacgctcaagggaggagagggcctacagcccactatgtttaacggggagctgggggccatcaagcaccaggcacttgacactgtgaggtatgactacggccactatctcataatgttggggccattccagccatggagcggactgacggcccctccgtgcccctacgccgaaagttcatgggcacaggcggccgtgcagacggccctcgagctgttctcggccctgtacccggccccgtgcatctcgggctacgcgcgccccccgggccccagtgctgtgatcgagcatctggggtccctagttccaaaggggggtctgctgttgtttctgtctcacctaccggatgatgttaaggacgggctcggagaaatggggccggccagggccacgggacctggaatgcagcagtttgtcagcagctacttcctcaaccccgcctgttccaacgtcttcattacagtgaggcagcgaggggagaagatcaacggccgtaccgtcctccaagcgctcggacgcgcatgcgatatggcaggctgccagcactatgtgctgggctccacggttcccctcggtggactcaactttgtcaacgacctggcgtccccggtttccaccgccgagatgatggatgatttctctcccttcttcaccgtggagtttcccccgattcaagaggagggcgcaagttctccggtacccttagatgtggacgagagcatggacatctctccgtcttacgagttgccctggctctcgctggagtcatgcctcacaagcatcctgtcacaccccaccgtgggaagcaaggagcacttggtcaggcacacggacagggtcagcggaggacgcgtggcacagcagcccggggtaggtcccctggacctgccgctggcggactacgccttcgttgcccacagtcaggtctggaccaggcccggtggggctcctcccttgccctatcgtacctgggatcgaatgacagagaagctgcttgtctccgcaaaacccggcggagagaacgttaaggtttcaggtaccgtgattacattgggagaacaggggtacaaagtgtcgttggatctgagggagggaaccaggctggcaatggctgaggcgctgctgaacgcagcatgtgccccaatcttggatccggaagacgtcttgctcaccctgcatctacacctggatccgcgccgggcagacaactcggccgtgatggaggctatgacggcggcgagtgactacgcgcgtggcctgggcgtgaagctgacctttggctcggcctcctgccccgagaccggctcgtccgcctccaacttcatgaccgtggtggcctctgtctccgccccaggggaattctcgggtcctctgatcacgccagtgcttcagaagacgggcagtctcctgattgcggtgcgttgcggggatggcaagatccagggagggtcgctgtttgagcagctctttagcgacgtggccacgaccccacgggcacccgaggcgttgtctctgaagaatctcttccgggcagtccagcagctggtcaagagcggcatcgtgctgtcagggcatgacatcagcgacgggggcctggtgacctgcctggtggagatggccctggccgggcagcggggagtgaccatcactatgccggtggcctccgactacctcccggagatgtttgcagagcaccccggcctggtgtttgaggtggaggagcgcagcgtgggtgaggtgctgcagaccctgcgctccatgaacatgtacccggcagtcctcggtcgagtgggcgagcaaggtccagatcaaatgtttgaggtgcagcacggcccagagacggtgttgcgccagtcgctgcgcctgctgctgggaacctggtcatcctttgccagcgagcagtacgagtgcctgcgaccagatcggattaaccggtccatgcacgtgtccgactacggctataacgaagcactggcagtctccccgttgacaggaaagaatctcagcccacgccggttggtgacagagcctgacccacgatgtcaggtggccgtgctatgcgccccgggcaccaggggccatgaaagcctcctggcggccttcacgaatgccggatgcctgtgccgacgggtgttctttcgcgaggttagggacaacacgttcctcgacaagtacgtgggtctggccatcggaggagttcatggggccagggactctgccctggcaggccgtgccaccgtggcgctgattaatcgtttccccgccctgcgtgacgctattctaaagttcctcaacaggccagatacgttctcggtggccttgggggagctgggggtgcaagttttggctggcctgggggccgtggggtcaacagataatccacccgcccctggcgtggaagttaatgtccagagatcacctctgattctggcccccaacgcctctggcatgtttgagtcccgctggctgaacattagcatcccggcgaccaccagctctgtcatgctgcgtggcctccggggctgcgtcctgccttgttgggtgcaaggctcgtgcctgggcctgcaatttactaacctcgggatgccatatgttttgcagaatgcccaccagatcgcctgccacttccacagcaatggcacggatgcctggcgctttgctatgaattatccaagaaaccccacggagcagggcaacattgcagggctctgttcacgcgatggtcgtcatctggctctcctgtgtgacccctcactttgtacagacttttggcaatgggagcacattccccccgcctttgggcaccccacggggtgctccccctggacacttatgtttcaagcagctcacctatggtcactcaggcacggtcgcccctccgagtgaccagtcaccttccagactatgcatacactgaatttagcctgatattgtccccctagccccgggcccagccctcctcagaaaactctgcatggagaagctggacgtgaacctcccccccagacctgtgtgctgtatttacaaacactacaataaacccaatgtgcaaatgtggtttgtatggctactttgtgttcctaaaaaatgcaacaatagaagtggaaaccctcagtcacgggacattaacctcaaccacaaaatgggggttggagaaagtaaccacatatactggagatgattcatgggctgggggttcccggacaatacacccatctggagttcaacctaattacatggtagataaattaagagtccctcctcaccactcgaaactatggcagacattctataagataacgaggagagatgaggtgagggcagaggacattgggcaggtgtgggccacggggcagctggccatatcccccgcactacagaagtgtaagcaaagtgaagggctcggaaggcaggcggggcctagcaatgtcacagctaaatgcccaccagggcacacactcaagcggggtctcggagctcctaggtcagaccacgaaaggtcagcctgcaaggtggatggcgtgttttctgaggttatccccgctacgtgcagtgctgggtgatagagaccctagaatgtgtcgaaatgaccaagcgtccccgcagcggggctcccaacacgggttcccagagagggtaaaagagggggccataaagcccagggtgtaaaacaccgaccgcgccaccagatggcacacgtgggggaaatgagggttagcataggcaacccccgcctacacaccaactatagcaaaccccgccccgtcacggtgacgtagtctgtcttgaggagatgtagacttgtagacactgcaaaacctcaggacctacgctgccctagaggttttgctagggaggagacgtgtgtggctgtagccacccgtcccgggtacaagtcccgggtggtgaggacggtgtctgtggttgtcttcccagactctgctttctgccgtcttcggtcaagtaccagctggtggtccgcatgttttgatccaaacttttgttttaggatttatgcatccattatcccgcagttccacctaaacggggcttaacgttgcatcccagaagatgcacgcttaaccccgcctacaaccgtgacgtagctgtttaccagcatgtatagagttacggttcgctacatcaaacaggacagccgttgccctagtggtttcggacacaccgccaacgctcagtgcggtgctaccgacccgaggtcaagtcccgggggaggagaagagaggcttcccgcctagagcatttgcaagtcaggattctctaatccctctgggagaagggtattcggcttgtccgctatttttttgtggctagttttgcacccacaacatgtaagggcccgctacccctacaacacaaaacaaactatctcccctaaccatccttttgccaatcaattctgtgacagggtttcctggacacccagtcttagttcaggtagacacccagttatgcagtgccaccaattccaaccatttttaaacctcctggaattctatcattaaacggcatgcaggaaaaggacaagcagcgaaaattcacgcccccttgggaggtggcggcatatgcaaaggatagcactcccactctactactgggtatcatatgctgactgtatatgcatgaggatagcatatgctacccggatacagattaggatagcatatactacccagatatagattaggatagcatatgctacccagatatagattaggatagcctatgctacccagatataaattaggatagcatatactacccagatatagattaggatagcatatgctacccagatatagattaggatagcctatgctacccagatatagattaggatagcatatgctacccagatatagattaggatagcatatgctatccagatatttgggtagtatatgctacccagatataaattaggatagcatatactaccctaatctctattaggatagcatatgctacccggatacagattaggatagcatatactacccagatatagattaggatagcatatgctacccagatatagattaggatagcctatgctacccagatataaattaggatagcatatactacccagatatagattaggatagcatatgctacccagatatagattaggatagcctatgctacccagatatagattaggatagcatatgctatccagatatttgggtagtatatgctacccatggcaacattagcccaccgtgctctcagcgacctcgtgaatatgaggaccaacaaccctgtgcttggcgctcaggcgcaagtgtgtgtaatttgtcctccagatcgcagcaatcgcgcccctatcttggcccgcccacctacttatgcaggtattccccggggtgccattagtggttttgtgggcaagtggtttgaccgcagtggttagcggggttacaatcagccaagttattacacccttattttacagtccaaaaccgcagggcggcgtgtgggggctgacgcgtgcccccactccacaatttcaaaaaaaagagtggccacttgtctttgtttatgggccccattggcgtggagccccgtttaattttcgggggtgttagagacaaccagtggagtccgctgctgtcggcgtccactctctttccccttgttacaaatagagtgtaacaacatggttcacctgtcttggtccctgcctgggacacatcttaataaccccagtatcatattgcactaggattatgtgttgcccatagccataaattcgtgtgagatggacatccagtctttacggcttgtccccaccccatggatttctattgttaaagatattcagaatgtttcattcctacactagtatttattgcccaaggggtttgtgagggttatattggtgtcatagcacaatgccaccactgaaccccccgtccaaattttattctgggggcgtcacctgaaaccttgttttcgagcacctcacatacaccttactgttcacaactcagcagttattctattagctaaacgaaggagaatgaagaagcaggcgaagattcaggagagttcactgcccgctccttgatcttcagccactgcccttgtgactaaaatggttcactaccctcgtggaatcctgaccccatgtaaataaaaccgtgacagctcatggggtgggagatatcgctgttccttaggacccttttactaaccctaattcgatagcatatgcttcccgttgggtaacatatgctattgaattagggttagtctggatagtatatactactacccgggaagcatatgctacccgtttagggttaacaagggggccttataaacactattgctaatgccctcttgagggtccgcttatcggtagctacacaggcccctctgattgacgttggtgtagcctcccgtagtcttcctgggcccctgggaggtacatgtcccccagcattggtgtaagagcttcagccaagagttacacataaaggcaatgttgtgttgcagtccacagactgcaaagtctgctccaggatgaaagccactcagtgttggcaaatgtgcacatccatttataaggatgtcaactacagtcagagaacccctttgtgtttggtccccccccgtgtcacatgtggaacagggcccagttggcaagttgtaccaaccaactgaagggattacatgcactgccccgcgggaaatacgtcctacccaggaacccgaaacagtgtttcccagaagctgtaaaaatagaacgccctggaactgccccactgtgcaatgcagcttttagccatgccatgctctataaatcacttccctatctcaggtaggcctgcacaccttaggtatggagcgaaggttagtggtcactctgcagtgcctggtgctgctttacctggcacctgagtgtggaggtacagaccaatgtgacaattttccccaaatgttgagggacctaagagatgccttcagtcgtgttaaaacctttttccagacaaaggacgaggtagataaccttttgctcaaggagtctctgctagaggactttaagggctaccttggatgccaggccctgtcagaaatgatccaattctacctggaggaagtcatgccacaggctgaaaaccaggaccctgaagccaaagaccatgtcaattctttgggtgaaaatctaaagaccctacggctccgcctgcgcaggtgccacaggttcctgccgtgtgagaacaagagtaaagctgtggaacagataaaaaatgcctttaacaagctgcaggaaaaaggaatttacaaagccatgagtgaatttgacatttttattaactacatagaagcatacatgacaattaaagccaggtgataattccataccctggaagcaggagatgggtgcatttcaccccaaccccccctttcgactgtcatttacaataaaatgaaaccttttattcttgattgcctcttgtgttcttgccgcccaggtaccttcctgtgttctccccacgggaaaaagaatagcttctgcagaaggccattgacgcaagttttgcccgtggggattacccgacccagccacttacagcacattttgttctaggtccatcttaggagcccgggccagcattctatcagcttaacgggaagagaagtggggagggcactcgcccactaaccttaacacctgcagcctacaaaagtacactagctgtttgctctattcgccactagagaccgccaagatgcgaaactacaggcccgggcccaggccttgcagggcagacggttaggctgacaaggggacaagtgtggcaggtgggcgggaaggggcacaagaatgccggcgaaactggaccacggtccaccccgccctcaagcgtccgggagccgggcggctcggctaaggagggcggccttgcgaacaattattagtagctaccaacaagggcccccagatgccccccaccagtcacccggccgtgtccactcacatattccactcttatttttaaattaatgtgtcccaattagaaacccaagcgcagaaattagttgagaggctagtgttttaaacatgcaccctaggccagccagagataatgtcacaagattatcaagttggtgtaaacacgccgtgggaaaaaatttatggttcagtgcgtcgagtgctatctttggaacagtagaaaattgaaccttgttggcgggagaaggaataacgccttatctgggaggagcgacggattatagccaataagagagctcaagacgcagggctcgcaaagtatagtggccccgtgggaccttagaggtggagcaacgtctaaagtggtaataacaccaggcggggctgggcaaaggggtcctacgggcgggattaattacgccttgcttacgcaagctcagttaattcgcccacgacttgaaaaatgtagcccttaaccaattggcggcccctaagggggggactaaggtcccactacaaaaactctgtgttctgctgcaaattttagatcagatggcatagagacaaggacaccgaagacccccagagccctcatcgcagggttcttaccatgcggccatgtaggcccacttaacactacaagacctacgcctctccattcatcatgtaacccacaaatcatctaaaccgtaagtctaagggcctcctgaggttttctcaggaggccctaatgtataattaatcatgcatttgattttaaaaaagtaggttacactcattttaggccagactttatttgcagattaataatttatgtgattctccttccctctaggactgaagaaacagcctcctgcacgtgagcatgtatctgaaataattattatgtcataagtgtaatgattagaaagtcataaacccacttccctttacatgaatctgggcactgaattttggggtacttctaaagactaacgtgttcgatttcggggtcacttccccttttataagtgtgtgaacagtgatttcagtaaaacctaagagatatttggtgtcacttccgcattttaagtttcagaaaattttaaaattaaaattgaaatttctctcaaaataattccaatgaaaacttcaaagaatcttatgtatgtaattcttttgccccaaactgggcttcagatgccttctattgcactctcacaaaaacattctggacacatgtgccagacgcctgggcctctaaggccctcgggtccccctggaccccggcctcagcaaccctgctgctcccctcctgccaccccagcctccccccctccccgtcccccttcgctcctgttcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctctcgcccaagctgctttgattcctgggatatttttgggaatggtgttaactttctccccttgtatttgctattcaatcaacctgattccccctgctcatacctccacttacaaccaagccactacggccacgtccccggcctcccgctcgggtaagtgctttttcatttttagccccagcccctcctctataagttctaggcaaacctccaatcaccagccaccttccaatgtagtctcttagagagtggctgctacgcattagagaccactttgagccacccacagtaaccacccagcgccaatctgtctacatagaagaagaagaggatgaagactaagtcacaggcttagccaggtgatttgtgaatttcagtttatttactttcttccaatcaagctttcccagcctccgcttgttaggtcctagttatgggttttccatgggggacttagtatccgttctattagattaacgtgcaagacgctaaacttaaccaaggtcagccaagggacgcgtgttatcccaggctgcccaccctgaggatttccccccaaaatcctcctaccctctctttatgccatgtgtgttgttggcttgtgttagtgctatgtaatgcgttgccgccaggtggcagcctgtttatagatgtgcagtaccccttaatgttaggtctgctttagggctgccaggtggcgcaatctaggattaattcacctgtatccctttccctccacccgcagtaacccagcactggcgtgtgacgtggtgtaaagttttgcctgaacctgtggttgggcaggtacatgccaacaaccttctaagcacccgcgcttgtgttttgctttatctgccgccatcatgcctacattctatcttgcgttacatgggggacaaacatatcatctaattgttgacacggatagtcttggaaacccgtcactctcagtaattccctcgaatccctaccaggaacaactgtcagacactccattaattccactaacaatctttgttggggaaaacacgggggtgcccccaccactcccaccaccccccccaccaccacccccaccacccccaccacccccaccacccccaccacccccaccacctccaccaccttcaccaccacccccgcccccaccacccccaccacctcagcgcagggatgcctggacacaagagccatcacctcttgatagggatccgctaggatatgacgtcgggcatggacctctagcatctgctatgcgaatgctttggatggctaattatattgtaagacaatcacggggtgaccggggccttattttgccacaaggcccacaaacagcccctcaggccaggttggtccagccacatgtcccccctctacgcccgacagcacccaccattttgtcacctctgtcacaaccgaggcttacccctccacaaccactcatgatgccaccaaggcctacccctcctacccctctgccacctgcaacactaacggtgccaccaaggcctacccgtcctaccactctgccacccacaccactactcacggtactacaaaggcctaccgaacttcaacccacaccatcaccaccacgcatgcatctccctgtcttgcatgtgccagaccaatcaatgcaccctcttactcatcaaagcaccccaaatgatccagatagtccagaaccacggtccccgactgtattttataacattccacctatgccattacccccctcacaattgccaccaccagcagcaccagcacagccacctccaggggtcatcaacgaccaacaattacatcatctaccctcggggccaccatggtggccacccatctgcgaccccccgcaaccctctaagactcaaggccagagccggggacagagcagggggaggggcaggggcaggggcaggggcaggggcaagggcaagtccagggacaagcaacgcaagcccggtggaccttggagaccagagccaaacacctccagtcctagcatgcctgaactaagtccagtcctcggtcttcatcagggacaaggggctggggactcaccaactcctggcccatccaatgccgcccccgtttgtagaaattcacacacggcaacccctaacgtttcaccaatacatgaaccggagtcccataatagcccagaggctcccattctcttccccgatgattggtatcctccatctatagaccccgcagacttagacgaaagttgggattacatttttgagacaacagaatctcctagctcagatgaagattatgtggagggacccagtaaaagacctcgcccctccatccagtaaaaacccttgccctctccagcaaccaatgtatcccaaataaatgttacttcttttgctcttaaccattgacacgcctgtcattctatcaattaaacaagggaaaaaggtttagctattccaccaacacgaccccaaggaaggcttgccaaaattggtgccttgctctcagcactttgccagcaacttatagcatggtaggcagctcaactcggcccgtcttactgcccagcctactctccactcccagtccatgttcgcactcctatgcatttcctgccctcccacttttaccccagtcccaacccaaaaccacacacaacacatagaattgttagtttaaacagtttattgataggtggctgcttttagcctaattgtgtattgctctcgttgccaaaacctgttgtaagggccggcacccgcaacatggggaaaacataaccgccgccatcccatggggagggtagaggcggttgacatgtaggtgagtagtgtaagaagcatggcgaagtagacaggttacttttagagtgtagtgtacagggccgggcgcaacagtgccaccaacccggggtctgagcattccatgggcagcagggacactgcactaccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccactgcacctggaatgcagggtgggggcgtggtcccctggaccccagccccgccgatccctcccccagggcgtacccggcttgcctggttctggggctcctctgggggtcgctgcatccgccggtagggttcgaatgggcgtggtccgcttgctctgctggcccggtacgcctggattgccggctgggggctggggtcccgggacgccccctccctgctcccacccggttccctcccccagggcgtgccccgcttgcctggtcctggagctcatccggggatgctgcatccgctagtccgacctgggtgggtgcggtccgctggccccaccctgggggtagccgccgggtctgctggtccggtgcacctggaaggcaggggggggggcagtgagggaggggcgtggtcctgggaccccgcgccgactggcagggggtccccatggcacaggcctaggggtccagggggcagccgcggcccagcgcgccccgttcacgggggaggaccgcggccgagccaccaggggcccggcgggggtggggggtgcgctcccaggccggaccctggtgccaggcagggaccccgcgccacccgcttcatggggggggaggccgccgcaaggacgccgggccggctgggaggtgtgcaccccccgagcgtctggacgacgctggcgagccgggccggctcgccttcttttatcctctttttggggtctctgtgtaatactttaaggtttgctcaggagtgggggcttcttattggttaattcaggtgtgtcattttagcccgttgggtttcattaaggtgtgtcaccaggtgggtggtacctggaggttattctattgggataacgagaggaggaggggctagaggtccgcgagatttggggtaggcggagcctcaggagggtcccctccatagggttgaaccaggagggggaggattgggctccgccccgatatacctagtgggtggagcctagaggtaggtatccatagggttccattatcctggaggtatcctaagctccgcccctatataccaggtgggtggagctaggtaggattcagctaggttcctactggggtacccccctaccctaccttaaggtgcgccacccttcctccttccgttttaatggtagaataacctataggttattaacctagtggtggaatagggtattgcagctgggtatatacctataggtatatagaacctagaggaagggaaccctatagtgtaatccctcccccccctacccccccctcccttacggttgcctgagcccatcccccaccccagcaccccggggtgacgtggcaccccgcgtgccttactgacttgtcacctttgcacatttggtcagctgaccgatgctcgccacttcctgggtcatgacctggcctgtgccttgtcccgtggacaatgtccctccagcgtggtggctgcctttgggatgcatcactttgagccactaagcccccgttgctcgccttgcctgcctcaccatgacacactaagcccctgctaatccatgagccccgcctttaggaagcaccacgtcccggggacggaaggggacttggggtgattttctatgtgggggtggaaatatgagcaagaataaggacggctccttattaacctgatcagccccggagttgcctgtttcatcactaaccccgggcctgaagaggttgacaagaagggtcaaggtttcgtctgtgtgttgaagggcaggggctgttgggtgcatctggaacggcttacctcgggtaactgtttgccattaaaaggttggggattaggtttagcccctttagctgccatttcgaaccggggtgtgcagatgcaggtctccgggtgggcaggcagtacgagatgtcacgttgtgttgtctttcctcccacccctgtcctggctgtggcaaatgcgaccctcatagagttgtgtttcaggtctgtgtcctgttttgcggtgggttatttcttccctcagtgtttgccagcttatttccccagttttcacgtactggggcctgtggacacctgagggagcggccgttggtgggtatgtgttggaattgctcccaccctcaattttcgcttgccttcttcccttgttaacctgatagcatagcctctaggtttccttgtaggtctgtttgggtttgttggttcacgtggtgctaacttgaattttttggttttctagttccctcttaattacatttgtgccagatcttgtagagcaagatggcctattcaacaagggagatactgttagccctgtgtatacgggacagtcgtgtgcatggaaatggtaccctgcatcctgtgttggagctagcagcaagagaaacacctctccgcctttcgccagaggacactgtagttctgcgttatcatgtgttgcttgaggagataattgaacgaaattcagagacatttacagaaacttggaacagatttataacacacaccgaacatgtggatctggattttaactcagtatttttagagatatttcaccgtggagacccaagccttgggcgcgcgttggcctggatggcctggtgcatgcatgcctgcaggacattgtgttgtaaccagtctactccttactatgttgtggacctgtcagttcgtgggatgttagaagccagcgaaggcctggatggttggattcatcaacagggcggctggtctacattaattgaagacaacattcctggatccagaaggtttagctggactttgtttcttgctggactgactttgagtctgttagttatatgtagttatttatttatctccagaggaagacactaatctatacattttctcagcactttatatgaatcagggtcattgggcctgcggggaactgagccagtaggatattaggcaagggtgacacagtgcccatgcattataatttaaccaaacagtggtcgtgagttttaggccggccatgggggcttacaagaataacatgccaatgacccggcccccacttttaaattctgttgcagcagatagctgatacccaatgttatcttttgcggcagaaattgaaagtgctggccatatctacaattgggtgtcctaggtgggatatacgcctgtggtgttctaacgggaagtgtgtaagcacacacgtaatttgcaagcggtgcttcacgctcttcgttaaaataacacaaggacaagatactaaagaaataactgaggtgagtgtgggaagatgggaatactatgtgttatgttaacgggtgagagcctatactgcagcccagactcggggggaggaggaaatggtaagagttatactctacttatcttttttgacactacatttaactgttatgtaacaatgtttgcttattttcatgttcaataaacgctatgttaatgatgaagaacctgtgttctttggaagtgggcccaatggggtagtaggttttgggagggtgccgtgctagatatttcaactgccacagaccccattttgtcccacctgttaccacattctaggtcctgcatccagtgggccaggtgtctcaccatggctctttctaggtggataccacagtccaggcccccaaggctaccgtgctaattacctcctcatgtccacccccaccctgtgttactgtcgcctgattatcctggcttagcagcctccaagttttacaagacgtcccattgccctgcccttggtccaagtctcgccggttttcagcagcctgttgtagcctgcccccaagtttcgcaggtttcccccatgcttccacccgttaacccaatagcatgacagccaatccaacacgaggcaagttttaagagttaaaagcaactactgtttattttccaaaatgagctgggtatagttgatgatctgtaggcgcagctcatccccacattccaggtccttgatggcctcgtagatggcatcttcgtcgacattgacagccttctcatataccgtgtctctggggctgacctttatacagaaggcgtcccctactaggtccacggccagctcgtaggtggggcctatgttttcacataacagtttcaagcaggtctctgggatgtgaagggaggtgccctggagcaggagatgcatgattaggcgcccttttccatttgtgctgaagatggggcagatggtgccacaaaagtgtccggtgaccaggtaagcgtagagaaggctgggttgggaaagtccagcctttactgcactgggagagctgctgagcagagacacatagaaggtcttgttgggtattatcttgtggacattgttgaagaaggagagctgggtggagctaaactcctgaggcacatgaacctgggacctattgatgcagatctcgcagtgagaccccagagtcaggctgtggccgaagggagacaggcgaaggcagcgcccgggggagagagtgcacagtgacagtgggagaaacacggcctctgagacatgtatgggggtgttcatctcacgcagaaaatctttgcccagctcaaagttggcagagattcccctgaagaagtcccgtagtgaaaaatgggatctgtctacaccatgtctggtgtgccgggaacatattgatcgggccacactgccaaccctttccattcttcccagctctgagcgagattttccacacctggacaccgacttcacgctatgcgccgaggcctttgaggccgtgtagtttctgtggtgcggatgcattaggcggcgcaatgcgggatctgccggtcgctgttggcgtgcattcacggcatctggggtgaccggggccatcgggtttacttttcacacgtagacctgggaagtttgataggactgtaccaggtcaaggccgtggatgcgcaggaccacgtccagttccttagtgacatccacgaggattgttttgcccactctggccacttgtgtggatttaaatatgtacacaagcgtaattaacgagtcacagaccccctgttccagattctgaccggctgcaagcgctgccttaaaggcctggaagctgggtgggtaaatctgaccaaacagcacgctcggattcgtgatgctgtggttgatggcacacagggggtcgcagaacaggtgcttgtggaagtcttgcggggtgcacatctgcagccaggcccttagcctggggcatggcacatccagcagcgtgttttgggtcttgatgaggaacacgatcctgtctaggattttgatgttgttgccgaacgagtcaagaatcaggctcttgaagcggtcaagggtgtccttggcgtccgggtgggccccgaggctctcgcagagtgggcagatggtccgtgaggcattcttgtgccttagtccaaacatgggggccaggaggcaggggccctgcgaatggtcgccagcctccggtctggtgatggccagggccaactccgccagctcatcgccgctgtattccgcgtttaaaccgatagcatggtggcctggccccccgagcaggtccgtcccctgccacgtacctaatagtagtccacagtagtcggccttggttgtaatttcaggagagagtcctcccttttcggccctgagaaatggatgctgaactcggtttctggtaggcaggtggcagcacagggcggtgtacaggcccctgccgacgtcccctgggacatcctgggaatctttgcaggttctgggtccagggagggtaagaaaagtgggggtggttctgggccacatggacttgaagcagaagttggccggggactggccggtgaggatggatttcagaaactccaatttgtagtagccgaggttggcatttctaatcatgtcagaagaggacacagggaggaagcaccggcaaatgtaaaagtgaagctggatgtcaatggcaagaatcctggagggcatgaagagggaatccaaccccccggccatggggaagtattttatcaggatgtgtaaaaagtccatgcctgtgatgaggctagagatccaggctcgtggggcatttagacagtagtagcagagcagggcatagtcctcaaagaaggccacgggggcatctgagtgattgaccagggtgtcgagcagatcacaaactcggcaggtgctggctggagagagggactcgtaggtgtggacgagtggtgggtaggctatgccttcttccgcgttggctggaagataggagtgggccatcaaaaggccgactgcctcgaactggcttttcagattgtccacggtccagggcacaaagtcctccatctttggagttctgcccgcgatctgtgccacctctgttacgccactcctcgtgagggggcagctggacagtctttttccggtcagggggtttggctcgtttgcgctcgtgactttgtgagccatgacacatctgggtggcaaggtgaggtcttctgggtttttaataccggggtcggcaccagtttctgggacaccgccacaaggacaaggtgggctagcaagttctcgagtctacgaagactccgggggcagtcttttgagtttctcgcctatgatccaccccaatctcgcccccctaattgcgccatctgcctacgcgaggctgaacctcctgaatcactgcatctttcttgaggcgtttaaagaagagaatagtggccagggcctcggtggggtccagcgtgaggtcttatttttgaaaagggatattataaaacaggtcattgctcggattgtggcagccgatagcaccctagatctagtgaatcatggcgagcccggaagagaggctcctagacgagctcaataacgtaattgtgtcatttctgtgtgactctgggtctctggaagtggagagatgctccggggcgcatgtgttctccaggggcagctcccaacccctctgcaccgtgaagctgcgccacggacagatttaccacctggagtttgtctacaagttcctggcctttaagctgaagaactgcaactacccctcctcgcccgtgtttgtgatatccaacaacggcctggccaccaccctgaggtgctttttgcacgagccgtcgggtctcagatcgggccagagcggcccttgcctgggtctctcaacggatgttgacctaccaaagaactccatcattatgctgggccaggatgacttcattaagttcaaaagccccctggtcttccctgctgagcttgatctcctgaaatctatggtggtctgccgggcctacatcacggaacaccggacgacgatgcagtttctggtgtttcaggccgccaacgcccagaaggcctcgcgggtcatggatatgattagtgatatgtctcagcaactgtctcggtctggtcaagtcgaggatacgggcgccagagtcacaggtggaggaggtcccaggcctggcgtcacgcactcggggtgtcttggggactcacacgttagggggcgcggtggttgggacttggataacttttcagaagctgagaccgaagacgaggcgagttacgctccttggagggacaaagactcgtggtcggaatccgaggcggcgccgtggaagaaggaactcgtgaggcaccccatccgcaggcaccggacacgcgagactcgccgtatgcgcgggagccattcacgggtggaacacgtgccccccgagacccgggagacggtggtggggggagcatggcgttattcttggcgcgccacaccttatctggcacgggtgctggctgtcacggccgtggccctgctcctgatgtttctgaggtggacctgacgttgcaggcccttggggagcgggggttctccaggctcctggatctggggctggcctgcctggatctgagctatgtggaaatgagggaatttgtggtttggggcaggcccccagcttctgaggcggctgtggcctctacgccaggctcgcttttccgaagccactcgtccgcctactggttgtcggaggtggagaggcccgggggccttgtccgctgggccaggtcacagaccagcccctcatccctgaccctcgcgccccatcttggcccgtccctcttgtccctttcagtggtcaccggtggtgggtgtggagccgtggccttttgcaacgcctttttcctagcttattttttggttgtgcggtctgttttccccgcgttttccgatagaatagctgcctggatctgcgaccggtcccctttctgcgaaaacacccgggccgtggccaggggttaccgaggcctcgtgaagaggttcttggcattcgtgtttgagcgtagtagctatgacccccccttgttgaggcaaaactctaggcctgtggagcgctgctttgccatcaagaattatgtcccgggcctggactcacaaagctgtgtgacggtcccgagcttctcccgctgggcccagtctcacgccagcgagctcgatccccgggagattcgcgacagagttacaccagcgactgcaccttcgttcgtggctgatcatgcctcggctctattggcctccctccagaagaaggcctccgacaccccctgtgggaatcccattcagtggatgtggtaccgcctgttggtaaactcgtgcctgaggagtgcccactgtcttctgcctatacctgccgtctctgagggggggagaaagacgggcgggggcgtaggggaggagctcgtgggggccggggggccctgcctgagccgggatgttttcgtggcgatcgtaagccgcaatgttctctcgtgtctgctgaacgtgcctgccgcgggtccccgggcctacaagtgtttcagatcccacgcctccagaccggtgtctggcccggattaccctcccttggccgtgttttgcatggactgcggttactgcttgaactttggaaagcagacaggtgtaggaggcaggctcaattcctttagacccactctccagttttatccccgtgaccagaaggagaagcatgtgctgacctgccatgccagcggccgtgtgtactgctccaactgcggctctgcggcggtgggctgccagaggctggctgagccaccgagcgcccgctcgggctggcggccccgaatccgggcagtgctgccgcacaacgcggcctacgagctcgaccgtggctcccgcctcttggatgccatcatcccctgcttgggacccgaccgcacttgcatgcggccggtggtcctgcggggggtgacggtcaggcagctcctgtatttaactttgcggacagaggccagagccgtttgctccatctgtcagcaacgccaagctccagaggacgcccgcgacgagcctcacctgttctcctcctgtttagaggtagaattgccacctggtgagcggtgtgcgggctgccgtctctatcagacgcgttatggcacgccggctgcccaagcccaccctccaggggaggctggaggcggattttccagacagtcccctgcttcctaaatttcaagagctgaaccagaataatctccccaatgatgtttttcgggaggctcaaagaagttacctggtatttctgacatcccagttctgctacgaagagtacgtgcagaggacttttggggtgcctcggcgccaacgcgccatagacaagaggcagagagccagtgtggctggggctggtgctcatgcacaccttggcgggtcatccgccacccccgtccagcaggctcaggccgccgcatccgctgggaccggggccttggcatcatcagcgccgtccacggccgtagcccagtccgcgaccccctctgtttcttcatctattagcagcctccgggccgcgacttcgggggcgactgccgccgcctccgccgccgcagccgtcgataccgggtcaggtggcgggggacaaccccacgacaccgccccacgcggggcacgtaagaaacagtagagggcacgaaacatggtgtatgcactttattaataaacaattacagatacaaaaacttgagtctctcgaggtctgcgatgaggcggtgggtggaacgctccagcttgcggcgaagctggctcacgaagcgagacagtactcggctagcctgactaagggtgaggctataacgcaggtcctgttccggggcggcggtggatagagaggagggggatccggaggggaccactaggtcgccggaggtcgaccctcctgtcaccacctccctgataatgtcttcaatagacagaaattgggtgaccactgagggagtgttccacagtaatgttgtctggtcgctagatggcgcgggtgaggccacgctttgcgaaaacgaaagtgcttgaaaaggcgcgggatagcgtgcgctaccggatggcgggtaatacatgctatccttacattttggcattttgggcagctgggaggcggcggatgggggtgcttcttttcgcacggtgtatgtttggggacccgcatgccggtactgggataggcgcacctcgggccgcgcgccaggctccgagccggaatgcattgggggcaatgggattgcgggggattgttgctgtctgctcctgacagggagagacacgcgcggcggagatgcagccgacggcggggccgcggtgggctgcccccgaggacgggcgccggccgccagcgcccccgtggcctttggcacgggcctggcacccaccgctttaattgtgggggtgggcagggcagctgcatcttggggcctttgtgcttgcgttttttgggggcgcggtgccaatgcaccaactggggtgtgcgccggggcggccaagccggaccccagggcgggtgcctgggggatgggaaagccggacggcgcttctcccgggtcgaacgctggagtagcggaggctgctgcgccggcggccaccacgggcgcacggggtcgcagcccgacggccgtggggaggcgggtggcggagggccgaatctccgcggcttcttcccggcccccctgctgtttcttctcccgttgcatgatagaatggccatagggtgggtcctgagaggaggcttgtgtgtcctggggctggagcccaaaagtcgttaaagatgccgctgatggtgtgggagctatgcctcccgtcgactggccgggcttgtagggggctgagggtggataactgggcttctgtgaaggcaccaaccctggaatctggatggtatgtttcttctgtgaccccgaggcagtcgatggtgtagagtgtggagacaatgtgtagacgatgggcccttgttcagaagcccagggacttgaggggggctgttgtggtgctggttggggaaggagctccagggaatctttgggccatggccttggggagcttcccggagaccggtctgggctctcggaagccctcgtttcggccccgaaatagggccttgccatcaatcgggggcctgggagagtgatgggggcggccaatcccggggtaactgtcacgtcccggggggaggaggtaggagacagccagtccctgggcctgccaggggccaccttctctaagagggggctctgtgggctgggagggccagaggcctcagattcagcagtagtgctccccttttccccctggtccgtctcccctcctcccaactgctggagccggtcggaggaggccggggtgttatctgctgactgaaacccgtccccgctgaccagtccgtgccccacccttggggggaaaccggagaacagctcctggacgttgcgtggattcgggggaagctggtatccaaccggcagtggaggatcttcgtgctcgtagaaggaggggttgagtacatcggtcggccatcgtgaggccccggccgcgttaaagtagaactgcacgtccggcagattgtgccgataggtgaaacacttccagatgatgttttttctgttggccaggatggccacggtggggggcctggcctccttaggtttggcggccctggcctcggtgagaagctcgcgtagccacacggcctggcgtgcaaagatggacatctctggctcgaaagactcggagtagccgtccaggtcctgcagaaaattcagcgagatggtctccaccagggaccggaagggctcagagtgcccgtcgcagtagaggaggggagcaacgaccctgacctgtcccagggtcttcaggttaaacagatattgagaggagacaaagagagttaggggccgaccgaggaaggccgccgccacggccgcctcaaaaacggagacggggatggtgtcaccggagcccctcttaggaccggtaatgggagtgccataaggcataagatttctcagggcccggccggtaacggtgccgtaggaagacggggtttcgcgggggacctcgagtccctccgccctggggagctcttctccgcgtgtataggcctgcttcacaaagtcgcgcaggtagtcctgaaatgcgaccgggccctccagcgggcgcaatgagtgccagagctgctgaagggcctcgggggcgaagcaccggcgtgcgaggagcagcatgcaggctcgggcgcgggccgtactttggttgtggaccaggcccaagaactcggggtgcggccagagggcggctcgggtatccatctcctcccaggcgtcctggaagaagatgaagccggtgggtggaccggcgatgcggtggcgggtgaggcggcgcgcgtcttccccgtcgttgctgccgcgggtggttgagggcatgccccccctcccggaggctggactcctgaccagcctgtaggtgaggaccgagtccgacaggaggtctcccaaacccccatctctcgctagagccgagaccaggccgagtcctgcgtagaacgatggggcgcccaggaaggcggcagcgtaggccggatgtgtgccgaccagcagcgccatcatctcccgttgttccaatagaataacttcccggtctgtggccggggctggataaggggggtgattcctagaggcgatgagactggcgtgcgctaaaagtgtcatggccacaatggggttgtctgccaggtcttccatcagggctttgggcgcagagacgtattcccgaagcagctccccggcgttggactccacgtcgggccaggtgtcccagtaggagtcggcggcggcggcgctgaggcgggcggaagctacactggccagggttcttctcctcctctcttggtcatcctgcgggggaccaatagcttgggggcgtccggctggggtcagggaaaaggcctctgggttctccagcacggtgggcatgacatattccagaaagttgtggtagacggggatgtagttgagcggctcctgggtgtctgcggagacgtaggccgggttaagggggtcgcagggagactctgtttccagccagagggtgccggcgtatttcgccggccctgccgccgccagaaattgtgcccgccgggtcggggctccattgccccatccagttggtggtgccgaaatcgtgatgaggaggggcaggttgttggtcaagggatgcttaacgaaaacggtaggctgggcggtctcgtaaaaagccaggaaactctgcttggccgaggcatagcgcagcagcttgtccttgaggagggcatactgggagccagccgaggccccaagcgccaggcccctggcagcctccaccacgatcttgagctggcgcgggtcggtgtggcccctggcctgggtgaccagatcctgcagcgttccctgcagctgggactcttcctgggcctcctggatgatggcctccagtcgggagaggcgccttttccagtctgcgacggtctccttgccccccgcgacccgcttggggtccaacgtggccagagccaacctcagctcctccatgccatccatggagttctgggccatgccctcgacttccaggagccgtgttagctcatgaatttcaccgtcagccgcagcggctaggttcagccaggcacccgcgcccccagctaaggccagggctccttcggaaagaccccgcacggcctcgcagatgccccggatccacttggcggctgccagggatttccggtagggccatgagccgttcccggccgctgcccgggccagggcggcctcgaggggagcctggacaggggctttgggcggggagggaagcaggctccggagttcatcgtcgggggcttcgtcgcgtgacctggagaggacggcctccagagccgtgtgaaagccccgccgagtgcttgccgccatctcgtgggccttcgccatcagggtctggctctcccggacctgctcttccagcgcccggacctcggccgcctcggcctcggtcagcagctccgagaagaagtcccccgtggcctggaggagatcgtcccgctctcgccttgtcagcagctggggcttcttaggccagagcgccgagtccgaggccagcctgggcggggcggttgcctgggggatagttggaggaggaggcaggttagcctggcctgggtcattagtggcttcgggtagcgtccgatccacgtactcgctcacgatggccgtcagggcagcctcggctgctcgtcttttttccagaagcccggccagcccccgctcgtactccgcgtagggggcctccagatccgtgttgaccaccgctgatttcatgtccggggactgcagggcctggcgcgtctgcgcgagggccgaacggatggcatcggccgccgtcctggcgcgaaagagggccccggccgcttcctccgctcctcgccctcctcctccttctttggcggtagccgcgggggtggcgggccaagcgtccagtctggccagagggccggtctcgatatccgtgaaccagccgggttccgcggcctccattctctccgccgcaccaccatcgtccacgagcagggatcgcagtctctccctcctcaccctcgttattcccaatagcatagcggcaaggatctgtgtgagggagtccaagatgtccgtgtttctggctactgccgccgctgctgccgcggctgagtccgtattgtctggcagcagggaggccagcagggtgttccagtcatcgggcgaagtgggagcgggctctgggcgtgcccccagcgccttcctaattctggcccaggcctcattcgcctctcgcgctcgccgctcctgcctctccttgtcttcctgttctcggagcttctccttttccttgcgcccggtctccataagctgccgcagcttcttctcatactgtcgcttgagctctttgttgggggcagtgtccagaaaggcctcgagctgttcctcggtggcgggcttaaagccttcggcctccaggcgccaggcctgcacctccttctgtctgagctgatcgttgttgttattcttcaatttctgcaggtaacttaggaagcgtttcttgagcttccctgggatgagcgtttgggagagctgattctgcagcccagagagtagtctcagggcatcctctggagcctgacctgtgatcgtcgcatcatagaccgccagtagacctgggagcagattcaccgccgcggccgtctcctttaaggtgctgtgagtagcaaaattctgcaaggccactaggcgcgctggctccagcgtcagccggttgcccatctcgaatgtgtgcagggcctctgagaccatggggtccaggatgcggtcaatgccatcctgcacctcagggtcaaggaccggcaagtcacgatagaggtggtctatgctctcctcgaaggaggcaatgtagttatcgatggtgtagaaggtgatggatttcaggatgttcatcaggtactttttggagcgaacaatctgctgtatagtgtcacgtaggcggatgtacgtggggttctttgcggccccgactatcgaccctgcatttgcgatgtacttttctatgacggggatggtgagggccgcggtgtcggccagcggtggcgtggcttcggggttgtcgtggttggcgggtgtcgcagagggagaggcgggagagatgggggcgcctggggccgaggccacaccggccaggcccaacattgcctcgatgtcgtccaggatggtgcggaggcgcttttcgttttctctggtggtctcgagctccttctgttttttcgcgactgtctcaaactctggaaggggggcaatgctggggtcgtcctcctcaactcgctccaggggccaggggataccgctcatatcactaagggcggtgcccaggtagaggagctcgcgatagtcccattcaatggacgtgtaccggatgtttaggagaggcagggaggcgatgatctggcatgtgtgccgcaggtgtgtcaggaggtcgtcaaaatccatcactgttgggaggcttgggtcctcaaggtaggagagataatcggaggccgccgaggccaccttgtccctgatgtccgccgtacacctgcgcacgtgcagggccgcattcttggaccggacggccacgttgtggacaaaggggggcactgaggcggcgggaggggccccatactctatcgctgtcaacagcgccaaaaagcggacgtcctcctcatctaccccagcctgttgtctggccacggccgttcgggcggcctccgccagggataggaggcgcttccagctttcgtcgtccaggaccaaggggacgtccacgtgcgggcccctgtagatggaattatcctcgggttctcctcctccttcccccgcctcctgatctccgcccgagagcaggtcggtcaggcgtctgcgggccgcctccaggtcaaattttccatcgtcgctctcggccagctggggaatttcagccagcatcttagcaccggcatctacacggaccgcgtccttcgtggccagggacggcaggcaggcctccagctttgcggccaggtgcttatggaactctcccgctcttcccttgttttctgatagcatgtttgcgaggttttggatgttaagttcggaagtgagcagttgctccaggtccagcgtggggacctgcagatgtcccgaccagtcctttaagaattccagcagatttagcacagacgatcggtccctactccttattagcccctgctcgaggaccactgtcacaagaagatagtctatcatgctcaaggcatctgcctctggcacttcccggttagaggccgggtcgtagacgatggcctgttcctggtaggtatgtccggctattctcgcaatgttgctctcgaggggcacaaagtccatctcaggagtctctatgtcaaaggtggtctgatagtattggctcctggcggtgtccagtgtgatgggggacgtgggggcactggatcccgattccaggctgttggagaacacttcatcttcgaacatgtcttcatcctctgtggtggggatatcggaggctaagtcgctctccgcttcttcagagtcggacatggataggaaaggctcctctaggtcagacaggtagcggacgaggccagaacccccagatgcatcatccccaaaggagggctgctgcccgaagggaggtgatggggatatctccgttccagccctgtcagcggccgggggatggtttttttctggttcgagtgtcgtggctgatggtgggagctgctgagcaggaggaggagccggggtagctgatggcaggggctgctgctgaggaggaagaggagaaggagcccgggcggctgatggcgggggctgctgctgaggaagaagtggagaaggagccggggcggctgatggcgtgggctgctgctgaggaagaagtggagaaggagccggggcggctgattgcgggggctgctgctgagttggaggaggagaaagagtcgtggtggtgggggctgctgctgcagtcggggaaggggatggggtggtcagagggatttttgggttcgagggagctgcctgtggcagagggatgggtatttgcaaagggaggcgaggagatggagtgactgaaggagcgatagttgagactggcgcggggtggggtgtcggggaggcgggtggtgattggtgagggatggggattactggagggggaaggcgagctgctgaaggggggcgatggggcggaacgtgggtgcgtggcagctgatcatcctctgtgtcagtggtggaggacagagggaggcggcggccggaggtgggcttcttgtgggggctatctttgcccaatccctttttcctcttgggagtctgaggcgctgcgccgctcgacgcccttggtggcgtggagggagcggggaccccgggggtgtgacctaggccggggatggggatgaagaggggagggctggaggccggggccgcggaggccggggccgcggaggccggggccgcggaggccggggccgcggaggccggggccgcggaggccggggccgcagaggccggggccgcagaggccggggccgcagaggccggagacgacggcggggagttggtctttgcaggactatacctggcggcagggaatgagtcggatgtgaaagatcgagagggcagtggcctgaggttatacggtattattcgccgttcaaacggtagcatgacgggagggctgctatcagcaccgggcgtccccgccgcctccccatcactggacacaagctcgggccccaccaggtcaaagccgctgccgttggcctcataaaagtcatacacgccatagtgttccagcataaagatgcgggggtcctctgtctcaaaggcctcgggtagaaaatagagatgcacgcaagtgtactgggcccctggtgcccccacgtactgcaggatgtcgtgcgcataggtgctgactctgacatgggcgggggtgcccggggccgcatccttctggcagtgggggtcaaacaagtagaaggagccatctgtctcgatgatgatggcccccgcgtagatgtcgcagatgtagaggatgaactgggccaccccgttgtaactgccgtgcaggacctcggccagggactgaacaactgccgagtttgcgatctgggcagggaataggacgaggccaaagatctccgccgagcggtatatgtgcacgcgcccaccgcccctcaggaccacggagctgggcacgtccgtcaactgggccatctcgtgccccttgaggatgccgctctggcgcatgagggcatccagccgcgccccctcgtccaggacctcgtccagctcagggcgggaggtcagggggcggccggccaggaagctcttgaccaggtagaggacgcagttgctgacgcactggatgccggcaaagcggccaaacttgcagtgggcctggttgcacgaggccgtgcctaggatgcggagggccgagcctccactcccgcccccgggggcattcacatccatggtcctgattccgcgcacggggccggttccccgggtgcgctggctttgcccccagtcgccgttactcatcttcggcggtggggcggggaggacgccttgtcgccccccttctggtccggggtcttacgcggctggcggcggcagccgccgagagataaggggggtacgtgtgtgcctccgcctctcctctgtctgggccgccgccgccgcttgcccgccttgaaggagagggggtagtccgcggactgcgtctgcgggggcaggaggtctcaaccttctgggctcgggccgcggtgtcgatatccgatggcctttccctgtcttcctcgtatgctccttctcctcctcctcccggcacgcccctgagatctgcctcccctccctctccctcgtcctggtcggaaaagtctgaggaggagaaggagaatggggaggagtccaaaacggcacgccacctgccgtggggcggtggtgacaggtcccggctggcccggcgcttgctcgcgttcctgccgttacccaggagaatggccgcgagttttttggcggggaggatgcggaatggcgggggcgtttgtcccacgggtgagggggaatcgtcggttagggccggcacgaggtggtgggtctggacccgggccgtgcgagcaaaggcggcgagaaccgaggggcttctgggggtgactgtgatctgttccggatttaggtccatggcgggtgtgtatgttttaataggggtggtctctggcgcggcaggatgatggtcgaggacgtccaccagggccttgcagatgctcttgcctagatacaggatgtcgtccatgctgaggggaggtggggtgtctgctcccccctgcggaagccgcctgggtgcggggatgaagacaggtggtgggcgggcgtctcgccggactatggcctcggcacgctcggcgtcgatggcgggtggctggaacaggcgggcgaatgtgtaatcccggaaccggtaggcgacgctgcgcctgagggcgcccgtcaggctgtatcccagctccagggcgtgctccacccgctcgttgagctcctcgagatccggacgcaggggctcgctggtgtgggcccagagggggtgatccgcgatgccccggctctccctgagggccggcaccaggaggcgccttctgagggtggccgtgtcggccgtggccagggcccacctggcggcggcgtcccggcacacatcctggatgccctccacgacgctctttagcgtctggaggtccgtggagtagtggcggggggaggatgaaacgctcttttccttcaccgctaccaccgcctcctcctcctcttccgtcgccagagggatctgcaccctcccggtctctgcgtcgtacaggagcgggcgggagcacagcctccaagctgcccccgtcaagcgcgagatgtcctccgagagggtctcacccgagaccagaaagcggcgggtggccaggcccaacgactccgccgtcgtgctgtatctcagggtgaagaggagtgaaaagagggaggtgggccaggcaagcggtggtgcttccgccgcccgctctgaagctgagatagtctcggagatgatgcctgagacctctcggacggcgtccatgatcctaaggactgcgtcgtgggacgacagcccccaggggcccccgccctcttcgtcttctgcaccctcggctcctgcgtccccggccttgccttccccctctaagttgagggggcgcagtccgaccgcctggggggactccccaggcatcggaggggccccgtcatagatctcccagacggtggcgtatatgagctcgagaggacggcgggcccgggtcagctcgggggaagggagggccaggtcgctgccgaaggagaccagccagcgcagggcggccagagagcgggttttgggcagctcgttggagaggacccggcgaagggcgggccagatttggaactcgatgaaggcggccgggaagaaggggctgtggacataggccggatccgcgcgcgccgtttggccggccctcagggaccggcagtatgcctcgacgtctgtccgcggggccgccgccaccgctgccgtccactgccttcttccctgctcgccggggagtagggggggcttacaggggagggccggagccggggccggggcctgccacaggcggctgtagcggacccatagcagagacctgaggagttcggatgaaaggtcccccgccacctgctcatactcggccgcgggaggggggacgatgaagatgcgcagaggggttacggcgtcccaagggtccgccgccgcccccacacccacagccgtcgcggcgggggcggcggcgggcgtagaggggccgctggtgcgccgggctcgtctgtccacggcctcggcctccgcccgcaggtaggccgcccgggccacacgggcgaagcggctcgtggggctcgcggtgggcagcagtcggaaaaagtgcagggcaaagcccgatagactctctaggagggcggcggtggcctcgagccacctccaccgcgagcgggacacccggggcacagaggccagcatcatggcgtagtcccccgccacggtctcgttgagcccggccgagagcagaaccgtggccacctgctcgatggcggctggagagaaggatgcccggctccccgccgcctcctgcacacgagcggccagggcctccatctctgccgccatcccggccaggaaggcctcgatgaccgagtctgggacgccgtaagtctggtcccagagcagggcctcgtacacatagtcgtaaaagagggcccctgagggctccaaaagccggagccgggcggcgtcaaaggccaggacgggcacagccgcgacggggggcgtttgtcccccgctggcctccgcgtacacgcccaggatctctaccgcccgccgccgggccaggggcagcgaggccaccacgctggaaagtgactcggggcggtgaaagagaccaccaccgctttcttcaccctctcccccgccggccccgcccccactgtgctccaccagctccacggccatggccttgatgtccgcggccgtgggctgaccctgccctgcagccgcccaggggtagcggttggtctccgcgtatacggtgaccagccatctccccagcgtcgttttcgccgcgttaaaagcgtagaatgacagcccctcccgcgggaaggcgtcccaccgggccagataagtgtcggccaccagctcttccacgaaggcaaaggtggccgttgggccagagaccgcgagcacctccccgctgccctcttcgatgatgcgccggtacgcggccgccagggcccgggtctctgcgatgagccgagagccgtccagcggatcgtcggtggccggagaggctgtcgtggggggcagtgaggatgccagcacgtccagggccgcctccagatggccgaggccgaagctgcgcctggaaaaggaggccgcccggagtaggtagtaggcgtggtggcggaggaccgccgccgggtaagcgtggccgctcatgagggtgagagtatttaaaaaatcgcgcaccagcaccggctgggccaaatcccccagtccaaagatccccagctccagaggcatcagcgcgcgcaggcgggcagcggggtcgtccccagacagcagcaactgacgcgtcacgcgggcgagccccccgtccacctctgccaggggtggctgggcgtctgcccctccgctaccgccgctgctgtcactctccatagcggacgccatgaaggtccaggggtccgtcgatcgccgccgtctgcaacgccgaatcgcggggctgctgccccctccggcccggcgtctaaatatttcccgggggtccgaattcacgcgggacgttcgtgggctggttgaggaacacgcgcaggcctcctcgctgagtgcggcggccgtctggcgcgcagggctgctggccccgggggaggtggcggtcgccgggggtggcagtggaggggggagcttcagctggtctgggtggcggccgccagtctttggggactttctgatacacgccagctccttcaacaacgccgaggccactggaacgccccttttccaattcaagcagagtgacccgttctcgggcgtcgacgcggtattcactcctctctccctgtttatcctaatgaatcacggccggggtgtagccgcccgggtcgaggcaggtgggggcctgacgcggatggccaacctgctgtacgacagccccgcaaccctggctgacctggtcccggactttgggcggctggtggccgaccgccgcttccacaacttcatcacccctgtgggccccctggtggagaatataaagagcacctatctgaataaaatcaccacggtggtccacgggcctgtggtcagcaaggccatccctcgcagcaccgtcaaggtgacggtgccccaggaggcctttgtggatctggacgcgtggctctccggcggcgccgggggtggcggtggagtatgcttcgtcggggggctgggcctgcagccgtgccccgccgatgcgcgcctctatgtcgctctgacctatgaggaagccgggccgcggtttacgtttttccagtcgtcccgcggccactgtcagatcatgaatatcttaagaatttattactcaccatccatcatgcaccgctatgctgtggtccagcccctacatatagaggagctaaccttcggggcggttgcctgtctggggacatttagtgctactgacggttggaggaggtctgccttcaattaccgtggctctagcctccccgtggtggagattgacagcttttattccaacgtctctgactgggaggtgattctctagacttaacgggaggaaacaggaggaggagggggacaagagcacaaaagtggttcagtggacacccaccacacagcatggcaacgaccagtcatgtcgagcatgagctcctctccaaattgattgatgagttaaaggtcaaggccaactcagaccccgaggctgatgtcctggccgggcgcctgctccaccgccttaaggccgagtcagttacacacacagtagccgaatatctggaggtcttctctgacaaattctacgatgaggaattcttccagatgcaccgggatgagctggagacccgagtctctgctttcgcgcagagcccggcctacgagcgcatcgtctccagcggctacctgtcggccctgcgctactatgacacctatctgtatgtggggcgcagcgggaagcaggagagtgtgcagcacttttacatgcggttagccggcttctgtgcctcaaccacctgcctctacgcgggtctcagggcagccctgcagcgggccaggccggagattgagagtgacatggaggtgtttgattactactttgagcacctaacctcccagacggtgtgctgctccacgccctttatgcgctttgccggggtggaaaactccactctggccagctgcatcctcaccacccccgacctcagctccgagtgggacgtgacccaggccctctataggcacctggggcgctacctctttcagcgagccggggtgggtgtaggggtgacgggggctggccaggatgggaaacacatcagcctcctgatgaggatgatcaacagccacgtggagtaccacaactatggctgcaagaggccggtcagtgtggcggcctacatggagccctggcacagccagattttcaagtttttggaaacgaagctgccggagaaccacgagaggtgcccgggcatctttacggggctctttgtccccgagctcttcttcaagctttttagggacacgccctggtcggactggtacctgtttgaccccaaggacgccggggacctggagaggctctacggggaggagtttgagcgcgagtactatcggctggtgacagcgggcaagttttgtgggcgggtctccatcaagtccctgatgttctctatcgtcaactgcgccgtcaaggccggcagccccttcatccttttgaaggaggcctgcaacgcccacttttggcgcgacctgcagggcgaggccatgaacgccgccaacctgtgcgccgaggtgctgcagccctcgaggaagtctgtggccacctgcaatctggccaacatctgcctcccgcgctgcctggtgaatgcgcctctggcggtgcgggcacagcgggccgacacgcagggggatgaactcctgctggccctccctcgactctcagtcaccctacctggagagggggcagtcggtgatggattctcgctagcccgcctcagagatgccacccagtgtgccacctttgtggtggcctgctccattcttcagggatcccccacttatgattccagggatatggcctccatgggcctcggggtgcagggcctggccgatgtctttgcggacctgggctggcagtacactgaccctccctctcgctcgttaaacaaggaaatattcgaacatatgtactttacggccctctgcaccagtagtctgattggacttcacaccaggaagatttttccgggtttcaaacagagcaagtatgccggggggtggtttcactggcacgattgggcaggaacagacctttctattcccagggaaatttggtctcgcctctctgaacgcattgtgagggatgggcttttcaattcacagtttatcgccctgatgcccacctcaggctgtgcccaggtgacgggctgttcggacgccttctaccccttctatgccaatgcgtccaccaaggtcaccaacaaggaggaggcccttaggccaaaccggtctttttggcgtcatgtgcgtctggatgacagggaagctttgaatcttgtcgggggccgtgtctcctgcctcccggaggctctgcggcagcgctacctgcgtttccaaacggcctttgattacaaccaggaggacctgattcagatgtcccgggacagggccccctttgtggaccagagccaatctcacagcctgtttttgcgtgaggaagatgccgcgcgggccagcacgctagccaacctactggtgcgcagctacgagctgggcctgaagactatcatgtactattgtcgcattgagaaggccgccgatctgggggtgatggagtgtaaggccagcgcggctctgtcggtgccgcgggaggaacagaatgagcggagtcccgctgagcagatgccgcctcgtcccatggaaccggcgcaggttgcggggccggttgacatcatgagcaagggcccaggggagggaccaggtgggtggtgtgtgcccgggggattggaagtgtgctataagtaccgtcagctcttctcagaggatgatctgttggagactgacggttttactgaacgagcctgtgaatcttgccaataaacgtttattgccatgtccaagttgttgtacgtgcgtgatcatgagggctttgcctgcctaacggtcgaaacccaccgcaaccgctggttcgcggctcacattgtcctcaccaaggactgcgggtgtctcaagctactcaatgagagggacttggagttttacaagttcctctttacgttcctggccatggccgagaagcttgtgaactttaacattgatgaactggtcaccagcttcgagagccacgacattgatcactactacaccgagcagaaggccatggagaacgtccacggggagacttatgctaacattttaaacatgctctttgatggggacagggcggcgatgaacgcctacgcagaggccatcatggccgacgaggccctgcaagccaagatttcctggctccgtgacaaggtggcggccgccgtcaccctgccggagaagattcttgtgttcctgctgattgaaggcatcttcttcattagctccttctacagcatagccctgctgcgggtccggggcctaatgcctggcatctgcctggccaataactacataagtagggatgagctgctccacacccgcgctgcctccctgttatacaatagcatgacagccaaggctgaccgaccaagggccacctggatccaggagctgtttcgcactgcggtggaggtagagactgccttcatcgaggctcgtggagagggggttaccttggtggatgtgcgagccataaagcagtttctggaggccacggccgatcgcatcctgggtgacattggtcaggctcccttgtatggcacaccaccccccaaggactgcccgctcacctacatgactagcatcaagcaaactaatttctttgagcaagagagttccgattacaccatgctggtggtagatgacctttgagtcagggtggctacttgctcaggtttctgggcataaattctcctgcctgcctctgctctggtacgttggcttctgctgctgcttgtgatcatggaaaccactcagactctccgctttaagaccaaggccctagccgtcctgtccaagtgctatgaccatgcccagactcatctcaagggaggagtgctgcaggtaaaccttctgtctgtaaactatggaggcccccggctggccgccgtggccaacgcaggcacggccgggctaatcagcttcgaggtctcccctgacgctgtggccgagtggcagaatcaccagagcccagaggaggccccggccgccgtgtcatttagaaaccttgcctacgggcgcacctgtgtcctgggcaaggagctgtttggctcggctgtggagcaggcttccctgcaattttacaagcggccacaagggggttcccggcctgaatttgttaagctcactatggaatatgatgataaggtgtccaagagccaccacacctgcgccctgatgccctatatgcccccggccagcgacaggctgaggaacgagcagatgattgggcaggtgctgttgatgcccaagacggcttcctcgttgcagaagtgggcacgccagcaaggctcaggcggcgttaaggtgacactcaatccggatctctacgtcaccacgtatacttctggggaggcctgcctcaccctagactacaagcctctgagtgtggggccatacgaggccttcactggccctgtggccaaggctcaggacgtgggggccgttgaggcccacgttgtctgctcggtagcagcggactcgctggcggcggcgcttagcctctgccgcattccggccgttagcgtgccaatcttgaggttttacaggtctggcatcatagctgtggtggccggcctgctgacgtcagcgggggacctgccgttggatcttagtgttattttatttaaccacgcctccgaagaggcggccgccagtacggcctctgagccagaagataaaagtccccgggtgcaaccactgggcacaggactccaacaacgccccagacatacggtcagtccatctccttcacctccgccacctcctaggacccctacttgggagagtccggcaaggccagagacaccctcgcctgccattcccagccactccagcaacaccgcactggagaggcctctggctgttcagctcgcgaggaaaaggacatcgtcggaggccaggcagaagcagaagcaccccaagaaagtgaagcaggcctttaaccccctcatttaacaccatgttctcgtgcaagcagcacctgtccctgggggcctgtgtcttctgtctcggcctcctggccagcacccccttcatttggtgctttgtctttgccaacctgctctctctggagatcttctcaccgtggcagacacacgtgtacaggcttggattcccgacggcatgcctaatggccgtcctctggacgctggtacccgccaagcacgcggtgagggccgtcactccagccatcatgctgaatattgccagcgccttgatcttcttctccctcagagtctactcgaccagcacgtgggtttctgccccctgtctctttctggccaacctgcctctcttatgcctgtggccccggctggccatcgagattgtttacatctgcccggctatacaccaaaggttctttgaacttgggttgctcttggcctgcaccatctttgccctgtccgtggtctccagggccctggaggtgtcggctgtcttcatgtctccatttttcatctttctggctttgggctctggaagcctggccggtgctcggcgtaaccagatttacacctcgggtctcgagcggagacgcagcattttctgcgcccggggagatcattcggtggcatccctgaaggagaccctccataaatgcccgtgggatctgctggccatctctgccttgaccgttcttgtcgtctgtgtgatgattgtgttgcatgtgcacgcagaggtgttctttggactctctagatacctgcccctctttctctgtggggcgatggcctccggggggctgtacctgggccattccagcatcattgcatgtgtcatggccaccctctgcaccctgacatctgttgtggtatatttcctccatgaaacccttggacccctgggcaagaccgtgctgtttatctcaatctttgtctattactttagcggggtagcggccctgagcgcagctatgcgctacaagcttaagaagtttgtgaacggacccctggtccatctccgtgtggtatacatgtgctgttttgtctttactttttgtgaatatctgttggtgacattcattaaatcctaacgaccggagtcctgtctctttgtgttcttgggggacttgagttagctgtctttcctcttattacattgggctaacgggaggaaatgaacccaggggtggcagtggatggggtcatttatgggcaaaactcacaggacatgtttggggagttagcattggcgtcgggaaacacagctctggcagttataaccgcaccagctaacaggacatgtttgggggagttggcattggcgtcaggagacacggctctgtcagttatcaccgtaccatgagtgccatgtgtgtccagtgcctaatcaccgttcctcattttgtgtgcctcctcaaatgttccagaagtcggccacaggggaggtggctgaattagggccttttccctcattcccccatgagacccacgtggcaggcctaggggctacattcgcctcccacgtttcccttcgcgtgaggcatccgatatgactgaattttcgcagtctcttttccctcttcccttgttattcccatagaattacagtgaggttacacaggtggagattcagtttaaccatttattgatttaatccaggaacaaaaaacagtcctagtgacccagtgcccggagagagaatggccctgacaagtcggctgcatgatgcacttcggcagtcacgtgtgtgagtctccacggcctctgtcaaaagggagcttagcgtgccagggttgtaattcttgatgtagtggcccaggaattcaacttcatcgtgtctccgtctgcagttggcgttaatgtaggctggggctactgccgcatatgctgccaagagacagaggggctgcttcacatatgagctgctcagggtctccaccaccttgttttgacgggccgtggcacaggtgatgtagaagagttgcttcacaaagttgtagtctcgcgtgttaggaaggaagcagggtgccagctctttgagcttggtcaggatcaccttgctaagactcatggcgcaggccaggaggatgtcttccgcgggagctaggggcaggtcgccgtggtaggtgatctcctggagccaaaagatggtctcttctagcatggccaccagggtgcagagccccgcgttctggatcgcctgcatgcgtgcatccagccatgtgtccttgttggttgacttggtgaaaaactcacgtagtgtcttgtagctcctgcgcagctcgtgtctgggttgcactttctgccaggctccaatctctggatgggcggccaccgccagcatcgactgtaggaacgggtcttggatgggctctagggtcagagaggccagggggctgggcaaggtgacaaatgtaatcttggagacaggcttaaccagactcatgtcaaaccacggtttgttcggcaggggcctctggctgcgttcttgcctcgcctgcttccttgtgctcctgccggcccctcgagattctgaccggggacctctggttgctctgttgcttcggggagctcttggagacctcggtgctctaggcaccctgggggcccttggggctctgggcgctcttgctcccgggggcaggtgtcggcgcttgccataactttcatcggtgcagccatggacctctccgcgtcgccttttgtggcctctggtgtaagaggagttgccagtctcctccttctcgtcctcgtccctgcacaggggtgagcgatgcaatgtgactgtcttgtcctgtaggtcccacttctttctgggaatcacaaacgatgccgaggtaggggttatgaccacgctggagggccgtgcaggtatggcgtgggccggagttggatcttcatcctcctcctctgaggatgaaatctctccatctgtggagtgttcttcgctgccctccatagggtccagatcgcagtctgtgttggtgtctgagaccgcttcgagttccagaatgtggctctctgcagaggggagacaaaaggtggagactgccttgagcacctctgtctcaggcaccggatgcccccggctccacggccccggccactggccggtgtagcttcttacctgcgggatcctcgttggaggaaatgctgctagttcgggagagtctctgagaaggaaccatcttgtctgtctctacgacgggctagctgggatgtagtgctgtcttgactggcctcagccctatttatgattctggaggcgggcacgctgatggagaaatgggcggtcggttgattggccccacagcgaccggcgaagcactgactcatgaaggtgaccgtgatggcctgtgatgtgtagtagagtaccagaaacaccctcacattcttggagctggccctgtgggtatgcctcaggcacgcaaagttcctgccccgggcatggcacacctgaactaagtttggcccggtttgctcaaacgtgacatggagaaactgggggaatttgtcttctggcacagctgttgccagggtgctcatgagcgagggccagatgcaggagctgacccaggcgacgagatccaggcccagatgtccctctatcatggcgcagacattctccacggtggggggcagggtctcgcgggtcctctggattagatagtcacgcccatcatccgcgatgtggtagcagaaggttttgggggccggccagcccacgtgcagtgagtgatgtaagaggttttgaatgttgagggcattcttaacatagctgtgcttgtcttcctcttccggatgacagacaaagaggcgcagctgccggctaagaccaccgcccctgtccaccttgtaggtatgcggcagccggatgcaccgcccggcgtgatacacgccgctgtcaaaaagcggggccccaatctctttgatcttgtgacgcatgcggcgcaggcaggccgttaggcccatgagcttctgcagcacagacacaaacccttgtactgcgcttgttcccacaatagcatggcctctaggtaggggggtgatgacgcgaaagcccagttttcccgtgcatatgcaaaaggggagcacatcttccatattatccgggtcggcgggtggacaagctgatttgaaaaaatagactgggtgggccctggacactggacccaggcggcgcatgaggcgcagtacctcacgccgcacggtccggcacaggtcatagatttcctccagcgaccagggggcccccttgatctttagatccaggtccaagaccaggttgcagaccggaagccggggattaaagtattcatgccgggagacaaagagctgctcgctcaggctgttctgtgaatagtacactggggtgtaggagagggccctggtgagacacgtgtctgggaggcggcagttggtcggggtggagacgacctccgccaggtgggatgagaaggggtcagcggctgtcattacaaagtagtgcctgtctgcaaaatggcagaggaagaccggtagccgctgcacccttcgaaggacggtgggtgggaggaattgttccttgggattccactggccccggcaggtggcctggccggccaagcatagaaacccttgaagcgtgggggggtatgtgggaccctcatccgcgtgccagcgcgcgagctccaccagctcccgggccacgtccacactgagcccggcccaggcccgcatgagtccgtcatcggggtcggggtcccacgtgtatggggccgggggctccatgcggattttcagctgctggacacgcacatgctcagccaggtaagtctcccgggtgaagtaggtgcgcatgtgctccgcaaagcccctgtccaggagcgaggggagcacgacgccccccgaaggcagacacccaatttctcccatgctcgttaactgagagtatcgcttaaaggttccctcgttgaagcactgtgcgtgggccaaatagacgtagcgcacgagatcggccgaggccaggggaaggcgccccctgtaggcgtctatcgtccttgccacagcgcggatctctcgcgagtcccgccgcagtttctcgtgtgcaaagtgggcaaaagcctcggtctgctccgcccatgccgaggagccaaagacctcccccagctcggccagggacgtgacggcggccaggctctgaccagactcggaagtaaatagctccgtgaggtgcgccagggtctcaatcgtacaaggaatgccccaaaaatagtaagcagccgtgactagcacgaactgggcctcgtgggagccaaaggtgctaatgaaccacctggccgagatgttaacgcggtagatgcggcgcagacagcccacgatcttgggacgcagccacgccacgcggcctctggcatccccctgtggctgtttcttagcgctcagtgtgagcagttccacgaggggcgtgagcgagcgcagggcccccgcgcgatctaggtaggtggatagacggtccgcggtgagcggcgtgaggccgcgcaggaaggggaaggcctcctccgccggcaggtgcagcgtcagaaccaggccgcagcggctctgtgaggtcagccgcttcttgggcaggtgaagctgcagttccacgagagaacccgccacgtggtggaggggcgaggcgttgtggcacaaacaaaacaggcggaagccctcgtcaggccgcgagaggatggcatcgaggatggcctccgcaatgtcagtgtttgaggccacaagggccttgatgacgacgggggcggacattatttaagaccgggaggccccaacggcgggctaaacagaacgatggccttctatctcccagactggtcgtgctgcgggctctggctctttggccggcccaggaatagatacagccagctccctgaggagccggagacctttgagtgcccggaccgctggcgagccgagatagatctgggcctgccccctggtgtgcaggtgggagatttgctaagaaatgagcagacgatgggctcactgagacaggtttatttgctcgctgttcaagccaatagcatcacggatcacctgaagcgctttgacgccgtccgcgtccctgagagctgtcgtggggtggtggaggcccaggtggccaagcttgaggccgtgcgctcagtcatctggaataccatgatctctctggctgtaagcggcatcgagatggacgagaatgggctcaaggccctgctggacaaacaggctggcgacagcctggccctgatggagatggagaaggtggccacggcgctcaagatggacgagaccggtgcctgggcgcaagagatctcggccgttgtctcatcggtgaccgccccctcagcctcggcccctttcatcaactccgcctttgagcccgaggtgcccacccccgtccttgcaccgcctcccgtggtgcggcagccggagcactctgggcccacggagctcgcgttaacgtagcaaccagactccacaccaaataaacattttattggtaaaacaagggatatgaaggtgtcattgacccgaggatccaaaccccctcccctgtctcccctcgagcgcctcgctcagcccactatcacccatggccaggctcggcacctcctcgaaggtgcagctggcccacctaaagagagatctggggccaaggacccccgcgtcactgtgggggctgtagaaggaggtgaggtggtgcttgtgaaggtaaacaagctgacagaagcgccggtacttgttaaggaacacggtctggtcactaaagttggtcaggctgacgtccaccccaccccggcgccacctgcagggcttcactagaataccctgcatggccaggcccgacctgccaaagattgtcggcctgtggtgagggatagaaggggggggcacggtgagtgtcactgagacggtctgatgggggaagagggccaggtcctttggcaaagagacgtccaggcccacgtccccggggtactgggggtggttgatgggacccttgtcctcctccatctggggggtggcatatctgaaggcagccaggtggattttgagctccgatggacgcagcgtggagttgtagcgccgctgattctggaggattagccggagttcccccgtgtagccgggatcgatgatgccaacatgagacgtgaccggacgggaggtgctgccccacagcatgagcccatgaccctcgggtgggcgggcatagaggcctaggtccacagttgtggtcttcatcgggcgcagcaggatggtggtcttgttgaccaaggtgagccgccctacactagcctgctggagcaacagcttgtcattctggaaggcgtagcgtatgtgtggacaggcctccatggtgatgatctaacagacagggacggcggcgctatatataagagcccaagacccggctctctttactgcgaaatggggaaggtcctaagaaagccgtttgcaaaggctgtgccactgctcttcctcgccgccacctggcttctgaccggggtgctgccggccggcgcttccagtcccacaaacgcggcggcggcttccctgactgaagcccaggaccagttctactcctacacatgtaatgcggacacattctcgccttctttgaccagctttgcctccatctgggcacttctgacgcttgtcttagtcattatagcctcagccatctacctgatgtacgtctgctttaacaagtttgtgaacacgctgctgacggattagatggggatatttaaaaggggcagcaatctcggctgtttgtacttcttctctgctcgttaaaccaatagcatgtcagctccacgcaaagtcagattgccttctgttaaggctgttgacatgagcatggaagacatggccgcccgcctggctcgcctggagtctgagaataaggctctgaagcaacaggtcctcagagggggtgcctgtgcctcgtctacctctgttccttctgctccagtgcctccgcctgagccgcttacagctcgacagcgagaggtaatgattacgcaggccacgggccgtttggcgtctcaggctatgaagaagattgaagacaaggttcggaaatctgttgacggtgtaactacccgcaatgaaatggaaaatatattgcaaaatctgaccctccgcattcaagtatctatgttgggtgcaaaaggccaacccagccctggtgagggaacacgaccacgagaatcaaacgaccccaacgccacccgacgtgcccgctcccgctcccggggacgtgaagcaaagaaagtgcaaatttctgattaataaatttttattgactttatacataggtctcggcgtcatcatatggtggggtggtgtaggtatgggatgtagacaagttacgcctaaaggcgcagtccgccatgaccagcagcagcagaagggtcagcacagccagagaggcccactgcagtactagcatggagaggtttgagaatctgggctgggacgttggcgggactggcacggtggcttgggctgtggtaaccggtgggctcgtaaaagtccagcggggccgcagtttgctagaagtgctgggaggtagataggtggtcgcattgtatctcggtcttggcgtagttgaatcaccgccgtaatctgtggtgggctctgtacttgtccgggctccatgtcctgtggtgtgctttccaccggtggtagaattggcctttccacctgttgaggtgaccgtgggaaccgccgtcttttggccactgggggcctggggcgacgttgcattttgggggggcgtgcctttggtgacattaacctcccccggttttgtggatgtggaactgtttccagggcctgacgcttggctggtggtgcctgggcggggtgctggcgaactggtggacacatgatgtgtgctgatagaggctggtgtcacctgtgttatattttcaccacctgttgggtgagcggaggttagtaaaggcatatgtgacgttgaattgtcactggtggaggggctgagtgtctctgggtttgaactgggtctcagtgacatggaagaggttgaacttgaagttatgttatgttggcctgtggtaacagcactggttgcattttttggttggctggtaactactggggtgggacttgttcctcctaaggtgtggttggtggcatttgcctgtggacttgtttctcccacagtagggccggtggcatttggggttggggtagtcactgctgaggtggggcttgtttttcccaaggtggggctggtggcatttggggttggggtagtcactgctgaggtggggcttgtttttcccaaggtggggctggtggcatttggggttggggtagtcactgctgaggtaggacttgtttttcccaaggtggggctggtggcatttggggttggggtagtcactgctggggtggggctggtggcatttggggttggggtagtcactgctggggtggggctggtggcatttggggttggggtagtcactggtgaggtggagctggtcatgtcgggggccttactttctgtgccgttgtcccatggagatggacttggtgtcaccggtgatgcgcctgacgttgtgccggctggtgttgggctggtgacatccgcggtggatacagtggggcctgtgcttgcaggtgcggtgaggttggtaggcacgtgagtagagctgggtagacctgtcgttgtattgggatcagcaaatccagttgtattcaaggtaggggaggtggtggtgctctcgggtgccttggagaatataaccttgtgggttgttgtggtggcattggtagccgttcgtgtgataatgagtgtcttgggggccgtgccaagacccgagacagtaatgtcaaatgtccgattgctcgcaaatgcaccagaaatattttcacaacccgaaggtgtccccgaggtgagagtccatttgcacttaaagtcagtttcagtgttgtttggccaggcccaaaaggcagtcactgtaacatttggcgagtttgcgtcctcagaagtgaccattggcactgaataggtagcattgtcacccacatatgtgatgtctgtggtgtttgtcggcatgtcctgtgaagctggaatctcatcagagaacacaatgttggactgaatgcagtaatctcccccgctcgccttcggtccattcccagagtaaaacacgtacaggatactgttattgccaagaaatcgtgacactggacgtggtgtcagacgcaggctgtatgcataccctgtaccaggtattggggtggccacgggactcgttgatgtgagaattccgccgctgggaacatggctctcgtatccactgcaggtgatgttaaatttgttgtctccgggcagaacttgtgaaatttcgccatcctccataatacactcaatatctatctcattaccgagcatttctgtttttacgctgaaattcgagtcttgagctgacgttggcaaacttaagggtagcgtgacatccagcccctgtgccctcactactgccgttatattggtagaattacagttatcccactttatgtatggcactgtttctggtatcaggtacacggggttttgcatttctgcatggtggcaccacatggttccaaacacatcttgaaagtagacatctacagattccaggcttacttgttgctcctctccggtggtgacgttaattggaagcttcttagaccgcatagttagagccaattctcctgcaccaaggagctccagtagaaagagattggtggcattttctgagccaccaaatgcacctcgaggttggtagacagccttcgtatggggtgtcagctggccaaagtcaagatcaagttgatgctttttgcccccgacatcgaaattgatagttacattgacatctgccgtgcaaacattgcatgtggggtaaaatgggaattccggaatctcaacattgaaaaaaccaggatcttcacccgtgagatggatcaggctctggatggtgtactgacacacaagcaaggctgcctccattgtctcggcaccgatttctaggcagcatcctctttaataggtacaaggggggtgcggtgttggtgagtcacacttttgttgcagacaaaatggacaaggacaggccgggtcccccggccctggatgacaacatggaagaagaagtcccatctacctcggttgtgcaggaacaggtatcggcgggagattgggaaaatgtcctcatagagttatcagatagcagctcagaaaaggaagcagaagatgcccacctggagccggcccagaagggtacgaagagaaagcgggtcgatcatgatgccggtgggtcagctccagcacgacccatgctcccaccccagccggatctccctgggcgagaagccattctccgcaggtttccactagatctaagaacacttcttcaagcgattggagccgcggctacggtgagcatccctatggcctaagtgtgtgatgtgtgtttttacccatcacacaacaacaaggtaagtaatttgttgccgttggtttcagcgcatcgacacacgagccatagaccagtttttcggatcccagatttcaaataccgagatgtacataatgtatgccatggccattcgacaggccattagagatcgtcggagaaatccagcttctcgtagagatcaggccaaatggagactgcaaaccctggccgccggatggcctatgggttaccaggcatacagcagctggatgtacagctacaccgatcaccagacgactcccacattcgtacatctccaggcgacacttgggtgcacaggtggccgtaggtgtcacgtgaccttttccgccggcacctttaagctgccgcgatgtacccccggggatcgccagtggttgtatgttcagagctccgtgggtaacattgtacagagctgtaatccccgctacagtattttctttgactatatggctatacacaggagcctcacgaaaatctgggaggaagttttaacacctgaccagcgtgtttcatttatggaattcctaggatttttgcagagaacggatttgtcctatatcaagagctttgtcagcgatgccctgggcaccactagtatccaaacaccgtggatcgatgacaatcctagcacggagacggcacaggcttggaatgccggctttctccggggtcgtgcgtatgggatagacttgcttagaactgaaggggaacatgtcgaaggtgctaccggtgaaacgcgagaagaaagtgaggacacggagagcgatggagatgatgaagatcttccttgtatagtgtccagaggtggacctaaggtcaaacgaccccctatatttataagacgtctgcacaggttgctgctgatgagagcgggcaaacgaacagaacagggcaaggaggtactggaaaaggcccgtgggagcacttatggcacacctaggccgcctgttccgaaaccaagaccagaggtcccacaaagcgacgagacagctaccagtcacgggtcggcgcaagtcccagaacccccaaccattcacctagcagctcagggaatggcatacccattacatgaacaacacggcatggccccgtgtccggtagcacaggccccacctacgcccttgccccctgtatctccaggggatcaactcccaggtgtttttagcgacgggcgagtggcgtgtgcaccagtacccgccccggctgggcctattgtccggccctgggagccatccctgacacaggctgcggggcaggcctttgcacccgttagaccacaacacatgccagtagaacccgtccctgtcccgacagtggcacttgagcgaccagtttaccccaagccagttcgtccggcacctcctaagattgctatgcagggccccggggaaacttctggcattagacgcgcgcgggagcgttggaggcccgcaccttggacgccaaatccaccccgttctcccagtcagatgtccgtgcgtgaccgtctggctcgtttgcgtgctgaggcacaggtcaaacaggctagtgttgaggtgcagcccccccagttgacccaagtatcccctcagcaaccaatggaggggccgttggtaccagagcagcagatgttccctggtgccccctttagccaggttgctgatgtggtccgggcacctggggtaccggcgatgcagccacagtactttgacctccccttaattcaacccattagccagggggcacccgtggccccgttgagggctagtatgggcccggtacctccggtaccggcaacacagccacagtattttgacatccccttaactgaacccattaaccagggggcatccgcggcccattttctccctcagcaaccgatggaggggccgttggtacctgagcagtggatgttcccaggtgccgccctgagccagagtgttaggccaggggtagcgcagtcacaatattttgacctccccttaactcaacccattaaccatggggcacccgcagcccatttcctccatcagccaccaatggaggggccgtgggtacccgagcagtggatgttccaaggtgccccccctagccaaggcactgacgtggtccaacatcagctggatgctttggggtatacactccatggtcttaaccatcccggggttcccgtgtctcctgccgttaaccaatatcatctcagccaggctgcctttgggttacctattgatgaggatgagagtggcgaggggtccgatacctccgagccgtgtgaagctcttgatttgtcaatccatggcaggccctgccctcaggcccccgagtggcctgttcaagaggagggtggccaggatgccaccgaggttcttgatttgtcaatccatggcaggccccgccctcggacccccgagtggcctgttcaaggggaaggtggccaaaatgtcacaggccctgaaactagaagggtggtggtgtcagctgttgttcacatgtgtcaggatgacgagtttccggatctacaagatcctccagatgaggcctaagcaaaggtgtagaagtgtgtccccctccattccacccactgataatacgcccgacaataaagttgatgatattgaattccacacctgcttgtgtttgtgattttatttcatattccatgagagagacctcgcatatttgcagaagggtcactgaaacatcttatcttaaaacagttacacctgaataatgaagaaagcgtggctcagcagagcacagcaagccgatgccgggggggcatctggctccgaggacccaccagattatggagatcaaggtaatgtgacacaggtgggatctgagcctatttcacctgagattggcccctttgaactctctgcggccagtgaggatgatcctcaatctgggccagtggaagagaatttagatgccgctgcaagagaggaagaggaacctcatgagcaggagcacaatggtggtgacgatcccttggatgtccatactcgccagcctagatttgtggatgtgaacccaacgcaggctccagtgatccaactagtccacgctgtctatgattccatgttggtaagaggcacctagaacatttccagatgtttcgcttggattttttggccagtcttaattgattgtcattggtttcagcaatcggacctccggcccctaggcagtttattccttgagcaaaacctgaacatcgaagaatttatatggatgtgcatgaccgtgcgtcacagatgtcaggccatcagaaaaaaaccattaccaattgttaagcagaggcgttggaagctcctgtcatcttgcagatcctggcgtatgggttaccgcacgcataacctcaaagtaaacagttttgagtcagggggggacaatgtccacccggtccttgtgactgctacgctaggatgtgatgagggcacgcggcatgcaacaacgtacagtgctggcattgtacagataccacgaatatcagaccaaaaccaaaagatcgaaacagccttcctgatggcacgtcgtgctaggtcactttcggcagaaagatatactttgttctttgatttagtatcctccggaaacaccctgtatgctatatggattgggctgggcacgaaaaaccgagtttcatttattgagtttgtaggatggttatgcaagaaggaccacactcatatacgcgaatggttccgccagtgcaccgggagacccaaagcagccaagccatggttaagagcgcatcctgtcgccattccttatgatgatccgttaacaaacgaggagattgatctggcctatgcccgcgggcaggccatgaatattgaggctcctagactgccagatgatcctataattgttgaggatgacgacgaaagtgaggaaattgaagctgaaagcgacgaggaggaagacaagagtggaatggaatctcttaaaaatataccgcaaacactgccgtacaatccaacagtatacggcaggcccgcggtgtttgaccgaaagtcagatgcaaaatcaaccaaaaaatgcagggccatagtaactgactttagtgtaatcaaggccattgaagaggaacacagaaagaagaaggcagccagaacagagcagccaagagccacgcctgaatcccaggcccccacagtggtcctccagcgaccacccacgcagcaagagcctggccccgtcggcccactgagtgtccaggctcggctggagccatggcaacctttgcctgggccccaagtgacagcagttctacttcacgaagaatccatgcagggtgtccaagtacatggttcgatgctagaccttcttgaaaaagacgatgaagtcatggagcagagggttatggcaaccctactgccaccagtaccacaacagccccgggctggcagaagaggcccttgtgtcttcaccggtgacctaggcatagagagtgatgagcccgcttcgacagagccggttcatgatcagctactgcctgccccaggacctgaccctcttgaaatccaaccactaacgtcccccaccacgtctcaacttagcagttcggcaccaagctgcgcacaaactccatggccggtggttcagccaagtcagactccagatgacccaacgaaacagtcccggccaccggaaacagctgccccacgccagtggccaatgcccctgcgacctatccctatgcgccccttgcggatgcagccaatcccatttaatcatccagtgggacccactccccatcagacacctcaagtggaaataacaccatataagcccacttgggctcagatagggcacattccatatcagcctacaccaacgggtcctgctaccatgctgttgcgccagtgggcacccgccaccatgcagacaccaccgagagcgcccactcccatgtcaccacctgaggtgccacccgttccccggcagaggcctcggggggcgcccactcccacgccacctcctcaggtgccgcccgttccccggcagaggcctcggggggcgcccactcccacgccacctcctcaggtgctgcccactcccatgcagctggcactaagggctcctgctggtcagcaggggccgacaaagcaaattttgcgccaattgttaacggggggcgtcaagaaagggagaccatcacttaagttacaggccgcccttgagcgtcaagccgctgcgggctggcagccttcaccagggtccggcaccagtgacaagattgtgcaggcgcctattttctacccacccgttttgcagcccatacaggttatggggcaagggggttccccaacggccatggccgcctcagcggtgacacaggcacccacggaatataccagggaaaggaggggagtggggcctatgcctcccaccgatattccgccgtctaaacgagcgaagatcgaggcctatacagagcccgagatgccgcacgggggggcctcgcactctcccgtcgttatcttggagaatgtcggccaggggcaacagcagactctggagtgcggaggaactgctaaacaggaaagggacatgttggggctgggggacattgcagtttcttccccttcctcttctgaaacatcgaacgatgagtgatttcgcccatgtaacaagaactgggatgaaccctggggcaacagactgcggggaggaggggggcagtgataagtcatgacaattttagatgaggtagaaattttgcatattttcagacccaccatggaatcatttgaaggacagggggactctagacagtcacccgacaatgagcggggagataatgtacagactaccggcgagcatgatcaggaccctgggccggggcctccatccagtggggcttctgagagattggtaccagaagagtcatactcaagagatcagcaaccttgggggcaaagcaggggtgatgaaaacagaggctggatgcagcgcatcaggcgaaggcggagaagacgggctgccttgtccggccatcttttagacacggaagacaatgtgccgccatggttgcctccacacgacatcacaccatataccgcaaggaatatcagggatgctgcctgccgggctgtcaaggtgagtatgcctctaactgggttcatgggggccatctaaggcccacgtgtgacccatgtttccattaattttagcaatcgcacctgcaagcgctatcaaacctgatactcgatagtgggttagacacacaacacatcttgtgcttcgtgatggcagccaggcagcgtcttcaggacattcgacgtggacccttggttgcggagggcggtgtgggttggcgacattggcttctaacatctcccagccaatcctggcccatgggatatcgtacagcaacactacgcacattaactcccgtgcctaacagggttggggctgacagcatcatgttaactgccacatttggatgccaaaatgcggcacgaactctaaacaccttctctgccaccgtgtggacaccaccccatgctggaccaagagagcaagaaagatacgctcgggaagccgaggtacgcttccttcgtggtaaatggcagaggcggtaccgaagaatctatgatttgatagaactgtgtggctctctgcaccacatctggcaaaacttgctccagaccgaggagaaccttttagatttcgtgcgtttcatgggtgtcatgtccagctgcaataatccagctgtgaattactggtttcacaagacaatcggaaactttaagccatattacccgtggaatgcaccacctaatgaaaatccatatcacgcgcggagaggcataaaagaacacgtaatccagaacgcatttcgaaaggcacaaatacagggtttatcaatgttagcaacgggaggtgaacccagaggtgatgctactagtgaaacgagcagtgatgaggacaccggtagacagggttcggacgtggagctagagtcctcggacgatgagctgccatatatcgatcccaatatggagccggttcagcagaggcccgtcatgtttgtgagccgtgtgcctgcaaagaaaccgaggaaactgccttggcccacgcccaagacgcacccagtgaagcgcacaaatgttaagacctctgatagatctgataaggcagaagcacaaagcacccctgaaaggccgggcccttccgaacaatcatcagtgaccgtggagcccgcccacccgaccccggtggagatgccaatggtgattctccatcaaccacctccagtgcccaaaccggttccagtcaagcctacgccaccgccttcccgtaggagaaggggagcgtgtgttgtgtacgacgatgatgtcatagaggtgattgatgttgaaaccaccgaagattcatcgtcagtgtcacagccaaataagccacatcggaaacatcaagacggctttcaacgttcaggccgacgtcaaaaacgagccgcgcctcccaccgtgagtccttcggatactgggcctcctgccgtggggcctcctgccgcggggcctcctgccgcggggcctcctgccgcggggcctcctgccgcggggcctcctgccgcggggcctcctgccgcggggcctcgcatactggcgcctctttccgctgggcctcctgccgcggggcctcacatagtgacgcctccttccgcccggcctcgtataatggcgcctcccgtcgtacgtatgtttatgagggagcgacagctcccccagtccaccggccgtaaacctcagtgcttctgggaaatgcgggctggtcgtgaaattacacaaatgcaacaagaaccaagttcacacctgcagtccgccactcagcctacaacgcctcgcccatcatgggccccatcagtctgcgccctctcggtgatggatgctggtaaggcccagcccatagaaagttcacacttgagttccatgtcgcccacacagccgatatcgcacgaagaacaaccccggtatgaggatcctgacgctcctctggatttaagtttacatccagacgttgctgctcaaccagctccccaggctccataccagggataccaggagccgccggccccccaggctccataccagggataccaggagccgccgcccccccaggctccataccagggataccaggagccgccggcccacgggctccaatcatcttcatatccaggatatgcgggtccctggaccccaaggtctcaacatccatgttataggcacccctgggcaccatggtctcaagatcctgtgcatgggcacacccagggtccatgggatcccagggcaccacatctcccacctcagtgggatggatctgcaggacatggccaggatcaggtctcccagttcccacatctgcaatcggagacaggcccaccacgtcttcaactttcattggtgccactggtctcatcctctgcaccatcatggtcatctccccagccccgagcccccatacgccccattccaacaagattcccccctccccctatgccgttacaagatagcatggccgtggggtgtgactcatcaggtacagcatgcccaagcatgccctttgccagtgattacagtcaaggtgcatttaccccactggacattaatgccaccacgccaaaaaggcctcgagtagaagaaagttctcacggacctgcccggtgttcccaagctactgctgaagcacaggagattctcagtgacaattctgagatctccgtgttcccaaaggacgcgaagcagactgactacgatgcatccactgaaagtgagctagattaaggggatccaaggtgacccctgttagctatttgatctttgactgacacataaacatggtttaaggaatgaacactcatggtgtgagactggaactgtactaaatttgctgacatatgtacaatgagagccaaaaatttgataaaccttaaaagtccccccatctaatgatgtccagttcccttctcccaccctgtacaccccgacccaaagggactcaatggcattcagatttctagttaccacaggtagaatatcgggcgttggcccataaaaataagtgcatggatatagctctgcacaggcttggaaacacccattccaggtgtgcttctttttggtgaaataaaaacagcatcctttatatgaaaatgtgtattctctggtgttgcagtatgtacagttagctttggtatagttttggggtacctgaaatgtgtgcagggtgggtgtccaatgtggcagttttacctctttgtccccatactcctgctcggccgtcttgttaaagttaaccggcggtggaggatccaccggccagacctctacatttggtttgggtacccaggtgatggccgcggctgccacccgccctcctcctcttaccctgggtggcaaaaagtatgccaggagtagaacaataacaagtgcgatggcggtaaacaatggcaccctcacctgcttaaatgaaaccatggcaaccacttcaaagagagccgacaggaagatatttattaatattccattagtaaacgaggcgtgaagcaggcgtggtttcaataacgggagttagaaatttaagagatcctcgtgtaaaacatctggtgtccgggggataatggagtcaacatccaggcttgggcacatctgcttcaacaggaggcgcagcctgtcattttcagatgatttggcagcagccacctgcggacaaaaatcaggcgtttagatggggcatttatgtttgggacgctagccgcctgggcattcgtgttagtatatactgacctcacggtagtgctgcagcagttgcttaaacttggcccggcattttctggaagccacccgattcttgtatcgctttatttctagttcagaatcgcattcctccagctgcgagcaagggaatgcgttactacaagtggtgcctagtcagttgaaacaagccccaccatccgctgccgcccctccatgagccccaccgtccgctgccgcccctccttgagcccctccttaccgattctggctgttgtggtttccgtgtgcgtcgtgccggggcagccactggtgcaggctgtggaacaccaatgtctgctagctgttgtccttggttagccccggggcaagcaaacaccactgctgctgctgtttgaacagtagaattgtctccaggttgaggtgcttctcccccggcttggttagtctgttgattctgggttatgtcggagactgggaacagctgaggtgctgcataagcttgataagcattctcaggagcaggctgaggggcagaaaaccacgacccagtcggagcggttgaaacatgataggcagttagctggccttgtggcagaggctctggcagcaccggccacagcacacaaggcaaaggagcttgcgatggccctcccaggtcctgatagactctggtagcttggtcaaaagcttgtacaaaaggcacctggtatgggtcaggtgtaaattttacatcttcagaagtcgagtttgggtccatcatcttcagcaaagatagcaaaggtggccggcaaggtgcaatgtttagtgagttacctgtctaacatctcccctttaaagccaaggcaccagcctcctctgtgatgtcatggtttgggacgtgctaaatttaggtgtgtctatgaggtacattagcaatgcctgtggctcatgcatagtttctaaaagaggaggaggcagttttcagaagtgtctaaaataagctggtgtcaaaaatagacagcccagttgaaatatgcatggcatgcagcagacattcatcatttagaaatgtatccaagatttcattaagttcgggggtcaggggggagtccagattcaaatcctctgtcatggactctagtgttgtggtcagttcgtccaaatggccacgagggggcgggtggctcaggtccatctgtccacatatggctgcttcctccttctggggaataacagtgtcagccatctcccttagggccttcacggcctgactggtttcttcatcagggtcctccaacagatgacttgcctcgggggttactgcgggggccgggtcaagtggctggggcaccggggctggcgttagggatccgaccggttcatggacaggtcctgtgggggtgggagccaaagaggcaggcaggggccggttggcccacggggatccgggtggatggaagggcctgatcctctttggctgacacacctctcgcccctcgaacacgtcagatatggcactgcccgcttccggctttggcaggaacataccttcccggctatccctgaggcccttcttccttttaacgggaggaagaaaggtgggctttgaggggtgggggaatatgggtctctcatcgctctcttggtggaccgctgctatccaaggctgttcaggttccgccgcgttggaaggacatggagtttgaccacggttgggcctggatgtccggcgcgactttggggcccgcaggcgcggggcctcggccctggcctcttcccgctcgctctgctcggtgtcactgttgcccgagtcactgctgctggaactgctgtcaccgcagtcggcgctttgggcaccgggcttcaggggcatggtcgggctcgggagactttcgagttcatctgtaaaagcatgaaactgtccggactccgagtagcgggcctcggtgtgagaggcacccccatcattccccatgagctcctcgtccatcctgtcggctccggacacgaggataggagtttccactgccttggacttggttgacagcaggcacgcgggaagcacgccgctcacgtagctcctctgtccggcgtggctggagtaggaggcccggggcagtgtcttaatcagagccctgacatccttaacatcgtccgtcagatggcctgtcttggacgagaccatagtctggaacatctcctcgaggacgggataggtgaacacccacttgcaaaaggccttgaacttggagcttaggaggccttccttctccatcctgttcaggtgttccactacctgcttgccggaggccatgatggccgcgcggtccacgcccagcaccttgctgtaggtgtaggcccgcacccgactgtgttttaggagcttgtacatagcggtgcctatggtggcaggaatcatcacccggttgctgggggcctggatgaagaatctgtcagtgaccactatcaggtggtctaacacgtagcgcatcactatagggcacgcgatggaacatgcgtcgttgccggcattctcagcccgtcttcttaccctgttgtttcggagaatggcccaaaaattgcagatgttgagcgtggccattagcccgccccattctcgcccgtgggccttggcctcatttataaatgccttgcatattttgtaggatctcagagtaatctccacactcccggctgtaaattccttgttgaggacgttgcagtagtcagagaccagagagcccagctgctttttgatttcaggagttagcctcagaaagtcttccaagccatcctttttaggcctcatggctagtagtaacagaggaaatgcccgaccattaaaatctttcctccatgagctttacctgaaacactatcccgaagtgggggatgtggtgcatctactgaacaccatcggggtcgactgcgacctcccacctagccacccactcctgacagcccagagggggctgttcctggcaagagtcttgcaggctgtacagcagcacaagctgctggaagacaccatcgtccccaagatcttaaagaagctggcttatttcttagagctgctaagctactactcccccaaggatgaacagcgtgacatcgccgaggttcttgaccacctcaagacgaatcgggacctggggctggacgacagactctgggccctgattaggaaactgcgccaagacagacaccatgcctctgtaaatgtcctcatgccaggaagcgactacacagccgtgtcgctgcagtactacgacggcatctccataggtatgaggaaggtaatcgcggatgtctgccgcagtggctatgcctccatgccctccatgacggccacgcacaacctctcccaccagctcttgatggcgtccgggcccagtgaggaaccgtgcgcctggcgcgggttctttaaccaggtcctcctctggactgtggccctctgcaagtttcgcagatgcatttactataactacattcagggatctatagccaccatctcccagcttctgcacctcgagatcaaggccctctgcagctggataatatcccaggatggcatgcgcctctttcaacacagcaggcctctcctcaccctctgggagagcgtggccgcaaatcaggaggtcacggatgccattaccctgcctgactgcgctgaatacatagacctactaaagcacacaaaacatgtcttagaaaactgttctgccatgcaatacaaataaatttctcttacctgcgtctgtttgtgtagtgaggtgttgtgtcctgtatggtattctactttaaaaaggccggctgacatggattactggtcttttatgagccattggcatgggcgggacaatcgcaatataaaaccctgaccatcacatggggcattaggcgactctgcatcagcatcgcttaagtatgagtgggcagcagagaggctcggttattttggttcctgaacatctggctggggcattaactaagcttatgagcgattttatcacaggacaagatgtcactctttctggaggaaatattgcagtcaaaattcgcgatgctataaaccagacccccgggggtggtgatgtagctatactttcttccctgtttgctttatggaatgccctcccaacatctggtagacaatcctccagggacgatttaatcccagccgccgtgcaggccttaaccacggcccacaacttatgtctgggtgttattccaggtgagacctcacacaaggacacacccgagtcattgctccgggctatcgtgacgggtctccaaaaattgtgggtggattcgtgcggatgtccagagtgcctacaatgtcttaagggattgaaggcaattaagcccggcctttatgaaatccctaggataataccacacactaagcagtgtagtcctgtcaatctcctgaacatgttggtccacaagcttgtggctttacgtggtcatgtgcagcttgcatacgacgcccgtgtcctgacgcctgactttcacgaaatccctgacctcgatgactccgatgctgttttcgcacgcaccttattggcagccttatttcacctcaatatgttctttattctcaaagattacataacacaagactccatgagcttgaagcaggccctcagtggtcattggatgtctgccacgggcaaccccctgcctgcagcaccggaaaccctgcgagactacttggaagctttccgaaattcggataatcacttttatctcccgacgacagggcctttaaacaccttccaatttcccgaagagcttctggggcgcgttgttgttattgattcctctttgtgtgccgccagtcacgttcaggacgttatcacccatggtgttggggcgggtgttcctcgtcctcggttttcggccctgcctccggccccatcccgcgagccccagcagacatgctctcagttaacgagcagagggaatgaaagctcacggcgaaacttgggccagcccggggggacctcccctgctgttcccccagtttgccccatcgtttccctgacggcctcaggggccaagcaaaaccgcgggggcatgggatccttgcacttagccaagcctgaggaaacctcccccgccgtctccccagtatgccccatcgcttccccagcggcctccaggtccaagcagcactgcggggtcactggatcctcacaggccgcacccagcttttcttccgttgccccagtagcatctctgtctggtgaccttgaagaggaagaggaggggtcccgagaatccccatccctaccgtccagcaaaaagggggacgaggaatttgaggcctggcttgaggctcaggacgcaaatcttgaggatgttcagcgggagttttccgggctgcgagtaattggtgatgaggacgaggatggttcggaggatggggaattttcagacctggatctgtctgacagcgaccatgaaggggatgagggtgggggggctgttggagggggcaggagtctgcactccctgtattcactgagcgtcgtctaataaagatgtctattgatctcttttagtgtgaatcatgtctgacgaggggccaggtacaggacctggaaatggcctaggagagaagggagacacatctggaccagaaggctccggcggcagtggacctcaaagaagagggggtgataaccatggacgaggacggggaagaggacgaggacgaggaggcggaagaccaggagccccgggcggctcaggatcagggccaagacatagagatggtgtccggagaccccaaaaacgtccaagttgcattggctgcaaagggacccacggtggaacaggagcaggagcaggagcgggaggggcaggagcaggaggggcaggagcaggaggaggggcaggagcaggaggaggggcaggaggggcaggaggggcaggaggggcaggagcaggaggaggggcaggagcaggaggaggggcaggaggggcaggaggggcaggagcaggaggaggggcaggagcaggaggaggggcaggaggggcaggagcaggaggaggggcaggaggggcaggaggggcaggagcaggaggaggggcaggagcaggaggaggggcaggaggggcaggagcaggaggaggggcaggaggggcaggaggggcaggagcaggaggaggggcaggagcaggaggggcaggaggggcaggaggggcaggagcaggaggggcaggagcaggaggaggggcaggaggggcaggaggggcaggagcaggaggggcaggagcaggaggggcaggagcaggaggggcaggagcaggaggggcaggaggggcaggagcaggaggggcaggaggggcaggagcaggaggggcaggaggggcaggagcaggaggaggggcaggaggggcaggagcaggaggaggggcaggaggggcaggagcaggaggggcaggaggggcaggagcaggaggggcaggaggggcaggagcaggaggggcaggaggggcaggagcaggaggaggggcaggagcaggaggggcaggagcaggaggtggaggccggggtcgaggaggcagtggaggccggggtcgaggaggtagtggaggccggggtcgaggaggtagtggaggccgccggggtagaggacgtgaaagagccagggggggaagtcgtgaaagagccagggggagaggtcgtggacgtggagaaaagaggcccaggagtcccagtagtcagtcatcatcatccgggtctccaccgcgcaggccccctccaggtagaaggccatttttccaccctgtaggggaagccgattattttgaataccaccaagaaggtggcccagatggtgagcctgacgtgcccccgggagcgatagagcagggccccgcagatgacccaggagaaggcccaagcactggaccccggggtcagggtgatggaggcaggcgcaaaaaaggagggtggtttggaaagcatcgtggtcaaggaggttccaacccgaaatttgagaacattgcagaaggtttaagagctctcctggctaggagtcacgtagaaaggactaccgacgaaggaacttgggtcgccggtgtgttcgtatatggaggtagtaagacctccctttacaacctaaggcgaggaactgcccttgctattccacaatgtcgtcttacaccattgagtcgtctcccctttggaatggcccctggacccggcccacaacctggcccgctaagggagtccattgtctgttatttcatggtctttttacaaactcatatatttgctgaggttttgaaggatgcgattaaggaccttgttatgacaaagcccgctcctacctgcaatatcagggtgactgtgtgcagctttgacgatggagtagatttgcctccctggtttccacctatggtggaaggggctgccgcggagggtgatgacggagatgacggagatgaaggaggtgatggagatgagggtgaggaagggcaggagtgatgtaacttgttaggagacgccctcaatcgtattaaaagccgtgtattcccccgcactaaagaataaatccccagtagacatcatgcgtgctgttggtgtatttctggccatctgtcttgtcaccattttcgtcctcccaacatggggcaattgggcatacccatgttgtcacgtcactcagctccgcgctcaacaccttctcgcgttggaaaacattagcgacatttacctggtgagcaatcagacatgcgacggctttagcctggcctccttaaattcacctaagaatgggagcaaccagctggtcatcagccgctgcgcaaacggactcaacgtggtctccttctttatctccatcctgaagcgaagcagctccgccctcacgggccatctccgtgagttgttaaccaccctggagactctttacggttcattctcagtggaagacctgtttggtgccaacttaaacagatacgcatggcatcgcgggggctagacctctggctggatgagcacgtgtggaagaggaaacaggagattggtgtgaaaggagaaaatctgcttctccccgacttatggctagatttcctacaactcagccccatcttccagcgcaagcttgctgccgttattgcctgtgtccgacgcctgcggactcaggccaccgtctacccagaggaggacatgtgcatggcctgggcccgcttttgcgacccctctgatattaaggtggttattttgggccaggacccctatcacgggggtcaagcaaacggcctggcattcagcgtcgcatacggctttccagttccccccagcctgaggaacatctacgcggagctgcaccggagcctgccggagttttctcccccagatcacggctgtctagacgcgtgggcctcccagggggtgttgctactcaacaccatcctgaccgtgcaaaagggcaagcccggctcgcacgcagacattggctgggcgtggtttactgaccacgtaatttcattgctctctgagcggttaaaagcgtgcgtgtttatgctgtggggtgcgaaggcgggagacaaagcttcactaatcaactccaagaagcatctggttctgacctctcagcatccctctcccctggcccagaacagcacccgaaagagtgcccagcagaagttcctgggcaacaaccactttgtcctcgctaacaactttttgcgtgagaaggggctcggtgagatagattggaggctgtagaggggtcatcactatggccatgtttctgaagtcgcgtggggtccggtcttgcagggaccggcgcctcttgtcggacgaggaggaagagacttcacagagcagcagctacactctggggtctcaggcctcccagtctatccaggaggaggacgtgagtgacactgatgagtctgactactcagatgaagacgaggagattgatttggaggaagagtaccccagtgacgaagacccatctgagggcagtgatagcgacccctcgtggcatccttcagattcagacgagtctgactacagcgagagcgacgaggatgaagcaacccccggctctcaggcctcacgatcttcaagagtctcgccatctacccaacagtcttcaggtctgacacccacgccttcgttctcccgaccacgcacccgggcacctccgaggccgccggctcccgcgccggtcaggggacgggcctcagcacctcccaggccaccagccccagttcagcaatccaccaaagacaagggtccccatagacctacgcgacctgtacttagaggcccagctccacgccgcccccctccaccttcaagtcccaatacatacaataaacacatgatggaaaccaccccccccattaagggcaataacaactacaattggccatggctgtaaataaaatgtcataacctggagtctgcatgtctgttgttttattcagtaaaccagtagtgcgcgtgagttctttagggcatccacgatgtagccgctcgcggggttcccctccccagtgatcatctcggataggggattcctgtccatgaccacgcaattagagtgccgggcccgggacagcgccacatacacatggccgggtttgatgtttctgtggctgccgaagcagatggcgactttgtttagggacagaccctgggccttggctatggtcatggccagctttgagctaatgccatagtcacggatgctgcagaggttcagggacttgtcctctatcgtctcatacagtttgttagtattgtgttccaggcagcacacgaagcctgcctcatccttgaccattagcctgggcatgcgtgaactgccagcgtcctgaggctgctgctttcctcggatgccaaagaagacgttgagatgcgtgtagcccagaagcgtgtagttctcggtggtggaggcgtagtccaggaggccgtgaaggagaggctcgtctgaggtgaactctatgttgtcgcgaatcagcatgttgttggtaaatgtgcagaaggggaggtccctgaactcccttccgccatagcggacggccacatccaggcattgcctgaaataggccctgaggtcattatatatgtttaacagggagcagaggggggcagaatttgcggccgggggagccagtactcgggcatagaagacagcggcggggctccgctccccatcccaggcaacctccagcggcagttcgcccagctccatcccagcagtcacctccggatcccacgtacgcccgggcaggggcacagcaccaagctccgccacgtattccccgttttcacagagagaatgtcctccgtggctaaaagcgtagatgcctccgtagatgagtcgggccaggaagctgtagacatactcgggctgctcatgcccgtgggcctccacgaagctgtccgcctcgagcgtgtccataaagtccccgaaggtgccggtatagccacagatggactttttggtcttgcagttgaccgacaccgagctgtgcttgacgtaggtgacattgtaggtgaccttgacccgttcttcgtcctgctcggtgcccaccgggaccatgtcttggtcggcgaactgcgagtagttaccgaggcgtgcataattcttttggagccaggtgtgggccgtgaggcccggaagcccgaccagggtcttgtactgggccaggggatcgaggaagacctcgcactccaccgggcaggtaaacatggtcaccccgcccccatctcccccggttccccgcgcggcacgcccctgcccggcagtcttgagcgtggcatggagggtggtgaggaaggtcttgacctcggcgtgggagaggaagagccgggtccagcccacgtactgcgcggggtccattatggccgccctggggacgacgaagcggtcgacgtaggccaggatgtccggcgagagctcgaggccgtactcgagggtcttcatgaggtgtccaaactggacgtcggtgcagcgcttgttgttgatgaagagggcccagttgcgggccacgtccacgtaggtcgcggccctggggttgcccaccaggaaggtgaggatgttgtcgcactcgcgaatcttgtttacctgggtctcgtggctaaaggaggactgaaaggcgtctgtctgggtgggagagcccacgcagacgatgcagggaatgcggccccggcggtagagtggggtacgcagccaggcgttgaagaaccagtagcaaaagaccacggctgttagaatgtgcacggaaagcgttccagcttcgtccaccacgatcacattggtggtccatagctgcccctggtgcatgtctctcaggacctcaaaggcggggccagagactcccgagtagagccccctgggcttggttcgcctgaactcggcggcaatgtcggagagtaccggccagtatttggccaggtcccgccgctggagttcctctagggcggcgtccgtagagcgaccatgactgctgacccgctgcgtcatatttatgtggcggctcttgaacccaaaggcgctatagacggttgggcagtaggctcggagtgtctgggagaggttctgtgcggccacggttgtggctcccgtgaccaggcagtccatcgtgtggtggaggcagctaacgctggtgctcttgccagcccccgccgttcccgtaattacataggctgaaaagggcaggaaggggggctccgagagctccgggtcaaactcgggggagaacgtctccatatccgggagttgttggacgcggcgcctagccagggtccctatcctcctgactatacgcctcacggaggcgtctgaggtcatgttcaacatgaacgtggacgagagcgcctctggcgccctcggctcctcggccattcctgttcaccccacgccggcctcggtccgactttttgagatcctgcagggaaagtacgcctacgtccagggacagaccatctacgccaacctccgcaaccccggagtcttctcgaggcaggtgtttacccatttgtttaaacgagccatctctcattgcacgtacgatgacgtgctacatgactggaacaagttcgaggcctgcatccagaagcgatggccgagcgatgactcgtgtgcgaacagctatgaccatgattacgccaagcttcaaaagcgctctgaagttcctatactttctagagaataggaacttcggaataggaacttcaagatccccagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacagcttcaaaagcgctctgaagttcctatactttctagagaataggaacttcggaataggaacttcaagatccccgggtaccgagctcgaattcactggccgtcgttttacaacgtcgtgactggccggcggcaacaacccagcggcgtcagcccccgccgcagttgcggcagaagccgcgtctgtagatatactgacgggcagcaccgcctccgcaatcgaaaagctgttcaactccccgtccgccagcctgggtgccagggtgtctggtcacaatgaaagcatcctaaacagtttcgtttctcaatacatccccccttcgcgggaaatgactaaggatctgactgaactttgggaaagcgagctgtttaacaccttcaagttaacacccgtggttgataatcaggggcagcgtctctacgtcagatactcgtcagacacgatctctatattattgggccccttcacctatctggtggcagagctttcaccggtggaactcgtgacagatgtctacgccaccctaggcatcgtggagatcatcgacgagctctaccggagcagtcgcctggccatctacatcgaggacctcggtcgaaaatactgccccgcgagcgcgaccgggggagatcatggcatccggcaagcaccatcagcccggggggacacggagcctgaccatgcaaaaagtaagcctgcgcgtgaccccccgcctggtgctggaagttaaccgccataacgccatctgcgtggccaccaacgtccctgagttctacaatgccaggggggaccttaacatccgagacctccgggcccacgtcaaggcccggatgatctcgtcccagttttgcggctacgtcctcgtgagtctgctggactccgaggaccaggtcgaccacctcaacatattcccccacgtgttctccgagaggatgatcctgtacaaacccaacaatgtgaaccttatggagatgtgcgccctgctctcgatgattgagaatgccaagagcccctccataggcctctgccgggaggtgctgggtcgcctgaccctcttgcactccaagtgcaacaatctggactctctgtttctgtacaatggggccaggacgctgctgtccaccctggtcaagtaccacgacctggaggagggggctgccacccccgggccgtggaatgagggcctgagtctctttaagctgcacaaggagctgaagcgcgccccatccgaagcccgggacctcatgcagagcctctttctgacctcggggaagatggggtgcctggccaggtcacccaaggattactgcgcggatctaaacaaggaggaagatgccaactcgggcttcacatttaacctgttttatcaagattctttattgaccaagcatttccagtgccagaccgtcctccagaccttgagacgcaagtgcctcgggagtgacacggtctcaaaaataattccctagaataaactgagaacagtcatcagtaaatctgtctctcgcgtgatttccataggaatggtgtagccggggtggagggccgatatcacatcaagcagaaaggccataatctctcgaaagtaggcggtggggctgagaccatgctcagtggccgtctggcagggggccgggcgcgctccgtccttgtccaggagacacacgtggcttccagagaggcgcagcccagccctccgcagccgctgaagccaggctcgcggaagagcccaaaacctgtttcggcgccgcccgggggccagtctccgggtcaggtcgcggaccagggtcaacaggtggtcgtgggatggcggggccttgtctgcctcgggtctcgccgctagttggtccagggtccaggagaaggcttcgtgccaaaccaaaaagggccccgagtgctccctacatccacccacgtaaagatccccctgaaagatggccatcagtaggcacccgggcccgcgtcgagccttcacccgaatgtgtctgcgggccacggtggcctctccacccatcacatcccggtcgagccggctggcatcctccgagtctttcacgccttgcaggaaagcctaggagatacagcaacagaaagctattagccggtggttcccccaccatcattcttcctgttaacgggaagaataagagttgggcaaaccccgggggccgcgctctcccacccagccccgcttctcacctgtgctagtggctcctctgaaggatgggcggaggttggtgccacaaagcccaggatgaactcgtctgcataagcccaggtcagtcctaggtcagcggccgcgtgtaggagaacccgggtgacggcggtgtagaggcccccgagtgcccgtcgcgtgtctgaggtgccatagcggtgaagggcccgcagccaggtttgcgcgtcccgcgcctgccctccgccatcaggcgttcccacgggggcgcccctggcagagaggtggcagcgggccaattcgtagagccaccaagtggcatcagcctcaaggatggctgtggcctccgcgcgcccgaccaccgtcgtctcgtcctccccccctccctcgccgccttcccgcgtgcaaacgtggcgagggttaatctcctttcgggtcgggggccagatttgttgtaggagcagcgagccgcgtcgttgccctgaccgcgcgtcgaggcccaggagggcgtctgccaggggcgtcccagagactcccaggttcaggtccagtagcaggagaccctcgctgtgtggcgcccggtgccagaaggccggcctcgcccgtcccacataatggatgggcaggaagggaaagcccgggacatagggctggaaatctgagccccctgggcagagttcggggtccaggaggtagaagatgggcttggtgcctctgtggttggcgtagcaggaggcatagatactgcggaggaaggcgtagagcccgcccccggccatactccaagagttgacaagccaggactcgaatcccccagccggctcaagaattttcaggctgacgcggtgccgtcgggcgtccccaccacggccggtggccccgtcggacgacaccagatctacttcataagtgaccggtcgcaggatgtccctaaaggggacgggagaggggtcgtcgggagtctcggtggaataggtgaaaacatccccacgcggtgtcctgatgtatacgtccaactgtccgggagactcagagtgcctctgagcatgggggcatgtctgttccccctccatctcggacccgaagccatcaacaggtgggggttgttggtcccgcccatcatcccccgagcagctttggcagaccacctgtgctggaaagagaggctggaagatgaggccctgctcatcctccaccctggcggcggacaagagtctgcggtctcgggttctaaatgaaaggtcaaataggtccttctcggcggcatcggcgagcatagcaatgagccccccgctgcgcctgagctcccgctcccatcgcaaaaagttgagttcggtagtcgagggcgcgttgaccacggggggctccagggagcctccaagcggcggctggcaggcctgcaccacgatcagagtctcaacgtcctcccttttgatgggcacgatgcccacgacccaaatcgcccaccaccgccctgcggtctgggtaacattataaaaggtaaccgagctgacgcgggccctgacgctctccgcgggtgtttccatcattgtttgagatctgaggaggactggaccctttaaaacatccggtcacgccctttgcaaattatttaaaaggtgaatgctcaactgagaccatcgcaatcatgaagtcctccaagaatgacacgttcgtctatagaacgtgggtcaaaacgcttgttgtgtactttgtgatgtttgtcatgtcggcggtggtccccatcaccgccatgttccccaacctggggtacccctgctactttaacgcactggttgattacggggcacttaacctgaccaattacaacctggcccaccacctgacccccacgctctatctggagccgccggagatgtttgtctacatcacactggtctttatcgcggactgcgtggctttcatctactacgcctgcggcgaggtggcgctaatcaaggcccgaaaaaaggtctcgggtcttacagacctctcggcctgggtctcggcagtgggctccccaaccgtgctgtttttggccatcctcaagctctggtccatacaggtcttcatccaggtcctttcctacaagcacgtctttctctcggcctttgtgtactttttgcactttctggcctcagttctacacgcctgcgcatgtgtgacccgcttctccccggtctgggtggtcaaggcccaggacaactctattccccaggacaccttcttgtggtgggtggtcttctacctgaagcccgtagttacaaacctgtacctggggtgccttgccctggagacgctggtcttctcgctcagcgtgttcctggccctgggcaacagcttttactttatggtgggggacatggtgctgggagccgtgaacctcttcctcatcctgcccatcttctggtacattctgacggaggtgtggctggcctccttcctgcggcacaactttggcttctactgcggcatgttcatcgcctccatcatcctgatcctgcccttggtcaggtacgaggccgtctttgtctccgccaagctgcacaccactgtggccatcaatgtggccatcatacctatcctgtgctcggtggccatgctcatcaggatatgccggattttcaaaagcatgcgccagggcactgactatgtccctgtctcggagacggtggaactggagctagagtcagagccgaggcctaggccctcgcgcacgccatcacccgggcgcaaccgccgccgctcttctacgtcctcatcttcctccaggtcaaccaggagacagaggcccgtctctacccaagccctcgtctcctccgttttaccgatgacgacggacagcgaggaggagatcttcccctaatgcaataaaaacttaaaacactgaggttactttcccgtcattctttcgggggaacgaggggaggcgggaattgggttaagataggggcgaagggtgggggtgggtgcaagaattggggctgggaatggagaggggagtgggctaggtgccgacaccggggtgccaagataatggattgagtaagcatggggctctgatcgggtccgccgggttctcaggggtgtagtgggtgggcattgcatatttttgccgcggtgctgttgggccttggactcggggtgatcatccgtaccatcacccgcacccgcaccccagtccacagccaccggccaaggtcctgggcctcccaccaccgttatgcctccccctttacccattaattacaagagatgttagtttggttttttatttggcaaaaacagcaattcatcattttcagagtcctcatcatattcgagcccctcgttggtttccccgcaggccctcccttcttcggccgctattagcttagtagtctccaggttaaactcctcatagtcattatacaggttgattattcccccgtccacgtcgcctatggagttgactcgtcgtcggcaaagagaccagagggcacccatggcgcggtgtcaaaagtattgtctgcgtacgctttccaggagccagccgcggtgctcaaggtcttacggatgacagagtccggcaggaccacgggtgtcaccagcaccgccacgggaatctccaccgaggcgtccagaagcaggtctgagccgagcgtgcaggtcgccgggtctagaggcgaccgttttcgaaagaaggccgtcacaatgttcacccggggtgagcagtctctcccgggcttgccacccccactgtggcggacgtagtctccaacaattttgtattggaggagcacctggtagaagtagttgtgccgtggattgatgaagatgttgactgggacccggtctttaataccaatgcgccccgcattttcgcttgggtccgtcattacgtagagcatagactccacccccctgttggcagctaggctgtctgccaccaggtcatgaccggggcccagtttgcgcttacggacatctttaagattccaggcctcatcctgcgtcaacagatagtcaccctccgagggcaaccgcccatccgggacgtactccacggtaggacgagctatagaattgataaatctgataaatgacctcttgcatggcctcttgtaaagcgcagtgtaggatgggtagatggggtcaaattctgacttggaaaagaggtacttgaagcggcacttaatctcataaatgcagctccggtcggtgaacagtataaagtctccctgtgactccacattgacgcaaagatccagagacaccccaaaaatgccatccgtgggactaatcataaagccaaattgacggttggcggatgcgtccccgcagatgagcttacagacaatgtccttgaccgtgtcctcacaccgcaggccaaaggccacaggtcccccaaagtagtgatttgtggagatgggagctggctcaaacaccttggtgggtccattcttaatggtggagagcagcttggaagaggaaattatgccatttcgcaatatgtcccacatcaggttctcagactgccccctggtcatggactccacgtacgagcagagaacagtcctctgctcgtcggtggcctcctgtagcccccagtaaatggatttcagggagggaccgtccttgctgtcattctcttggactaacgaggagacaaagtcacagaagccagtttcaccagagaactcttgtatttgtttacagaggcaatagagatagacaaagcgcatggccggcatctgaggtggacggtcaaggttacggacaaaggcctcagtctccggactgcggaggaagcgggcaaacgtgtaggaggtcatctcctccatgggatcctcgagctcatccacgtcggccatctggaccaaagaagtcgtctgccaagagttcagctaccagacctggaagatgagggtgctcaaaccgtgggcgacagttgaagaagtagctctccttgaacctctttttaaggctccggcaccactgcaagaattgactcatatgctccgccgtgacatccacgcacggactctcgccacacgaggtcaggcccatgtctaagttcaggttccacatctgcgacagcacctccaacagcaccacctttggggctgcaaattgcaaaaagtagagcgggtcggatcggtcaaatcccatgtcagggttggggtaggggattttgtgggtggagtcagcgaggtgcatgataccatagagcagcgagtagccgagcgactgcagatccaggcgaagggccgtctgcgcccccacggggccacacgccgaggggtcagggatgtgcccagcccccctcaagatgtagcacttgctcaaaaggcagaggggcttataggtgtccttggctatagaaaatggttccctctggcaatagaggcgatagagctgccggcccttagaagactttagccgcacatccagcatcttgttgcggtcgtggagggaagcagtcccataatcagtcaggaccagcctacccatgccccacatggtgtctgtgaaatccaccaggatgttgctggggctaatgtccgaatggaagaggccgcagtgccgattcagaaagtaaacggcatctttgaggccctgaaagccccgcaccaggggctcaatactaccatcatgccagtggccataatcctggagactgcatctgaactggggcataaacagggcgtggcaggacgtgcaggccgacaggtagtccaccagggccttgtcctgcccatcctcggccgtggccttcccaatctgaatcatgtcacacaccatgagctcgtgatacagctccgtcacagagtcatagagtttgaccgtggcattatctgcatgtgcatacacggccccgtagctcccccgccccagcagatactcgcaggtaatggggaggtgatcacagcgcgtcatgttctccggcagctttacatagagggtctccgtcatgtcatcaatgttggtcaccttcaggtgtttgtgctgaaaggtgaagtaatcaatgacagtcaccttccccaaaaaggcctgggtctctcgagggggttctggggagacactcaactcgccactgctggaggagttcgtcgggctcaactccgcagccatattcacatccatgttcctcaaatggctcgagggcctgtcgcagctcgtctctggcctcaagctcctgctcacggagctcctccacccgctctagctgcttgtagttgatttttggaaattgagtcttggtcgcggtgaccaccctctgataggtagaaattagctgtttggactcaaacgtctcccttgcgtggcgcagggactctaaggcaccccgagcagatgtaaactgtgtttcaaacagagcgtggtccctcccaaatctgtcacgtgcgctcacagccgctctcttttctaccgaggctcttagttgctgggccaccagatctcgcttagaactactcatcttcataagtcaccatgtccgcaactatggagcccagatcatacgtggggtagagtacggtagttccagtggaggcttcccggtaatttcccacagcgtccaccatatatctttctgcctctcccgttagaattaggcaaggatcatacgtgtccaccggccttttatactgagcgtttaggttttgtttatgtagcaagcacaaaaggcacacacgagtgatgcaaaagggttcctgaggcagcaggcagagctgttttgccattttattcaggcggctaacgtcaaagggaggagctatatcctcacccttccagtcacgcacgtccaagtacagggcatacacacacctggtgaggtgtgccaggaatgcctctatgttggcacatggtgtataaaccgcagtgggtagcagaatagggccccttttgccccgtgccgcagcgtaaacgcagtgacgctcttcgcagtgggacctggggccgtagaagagggcccacatccaagggagtgggtcttcaggcaccagggaggtccaggtttgggagtgggccaatatttgcaaggcctgacctataacctcatctttgttccaggccagcgcaattcgcataaggtccccatcaaacacctcaaaacacagacccatgcccatttcaggctgagagggctccatccggctcgaccaaccttgtccaccaaactgccattcttctggtaaacgggggttgaggggcaagagctccaaagccaggctcgagaagtcatagtcatcctcggccacacggccggagctccgggcctcgtgccagggcctgttgtcctgggggaggatattggacacgagcaggaagctcttgagtggcgtctccaccagcttaaattgctcgggcgtgtcctggcaggcctccagtgccagttccagacactgcccatacctgcgggcgagcatcgggtcatcgggcatatcggccttgaccgcgttgaacatgctgtatgcctcgcagcgcggccgtctgaccgagaacctaagaaacgcccttcagcaggacagcaccacgcaaggctgcctgggtgccgagaccccgagtattatgtacacaggggccaagtcagacaggtgggctcaccctctggtgggcacaattcacgccagtaatttatattgcccaatgcttcgagcatactgccgccactatggccccaggcccgtgtttgtagcttctgatgaatcattacccatgttcggtgcgagccctgcccttcacaccccagtccaggtccagatgtgcctactaccagagctacgcgacacgttacagcgcctgctgccaccacccaatcttgaagactccgaggccttgacggaattcaagaccagcgtgtcctctgcccgtgccatccttgaggaccccaactttttggagatgagagagtttgtcaccagcctggccagcttcctgagtggtcagtacaagcacaagcccgcccgcctagaagcattccagaaacaagtagtgttacattctttttattttctgatctcaatcaaatctttagagattacagacaccatgtttgacatctttcaaagtgctttcggattggaagaaatgacgctggagaagctgcacatttttaagcaaaaagccagcgtgtttcttatccccaggcgccacggcaagacctggatagtcgtggccatcatcagcctcatcctctcgaatctctccaacgtgcaaataggctacgtggctcaccagaaacatgtcgcgtccgccgttttcactgaaattattgacaccttgaccaagagcttcgactccaagcgtgtagaggtcaacaaggagaccagcaccatcacgtttaggcacagtgggaaaatctccagcaccgtaatgtgtgccacctgcttcaataagaatgtaagacctgacgtttcagtacttggcaattgtagagcatagcccggctgtaaaggtcagaaaatcgcagcagggtccaaggttgtgctgtacatgggacctctttcccattagcaagaaccccctgcaggacacgtgacatgtccgggtgcattttgggtgggttaaatctcagtcccaccacaaagggggcatcctccggtttgaacatcagacccaacaaagcccgatgcccagttatgggtacgtagtcgttgttcagggccgtgcatggcagcagacaaggacaggtgccagatgtgcctgggctatcgtcctccgtccagccacgcaggatgttcacgtgggccccggcaccatagcatgtcacacattccccgttatcacatctggttagcaggttgataaaatgggtcagtgatggaaaggttggcatattggggcagcacatcagcatgtccatgttaacgaaaaacatgtacagggccccttctgcataccaggcaccaccccgtcccagtgggatgatctccgagggtgtgatatcttgcagttcttctactgttttaacggcggttgaggtggtaaagacgtgggccgtggtcagatctgtgcaggtgactacagggttacccctaatctccacaggcaccgcctcacccactgcatctgagaataccccaaagtacatgagagtcaggctgtgtggcccctggactgccttagtgaagagaacctcgggcctggccacggtggctagggttccattgatgtagacggtcacataggtgggcttcttcttgggcttcagcacaatgagggtaacattcatgtaggttttaggaggtccggctatctgaggcacgtacacagctgacacggcggttgtggccgtatagactttcatctggggcgtagaggcatcgctcagcacccagaggcactccttgttgaggaacttgcgaagctgttcccggctactgttcgcggcggatgccatgacgtgccagaatatatcccctctcctcgggggtgagtgccaattggcctttaataacaaagcccccaggcagcaccaaaaatgcctgcccgtccgatgtggtggccaggtggacgcagtgcccgtcagttccaagggctactagctgggaagcagccccaaccagcccacccgggggcctggagtcgatcaccttaccccaggccgaggccccttcctcatacagcgggtggctatctatccataggcaggcatccggcgtctttggtgcattggagatagtagctttcacccaacaactttcccaactaacccgtgtctggacagtgaagaacgcttccctgatcaggtctgaatttttatagatacgggagtaggaggtgggaataacaactgggatttcttgttgtgctgtccaggcctgcatggccagtttttccctgaagctagcagaaattctgagggccactgaaatgaggaagcgaaactccctctctggagctcccaaaattgaaacctcagcaagatctgttgctggggaggcatgggtgacagctgtcatcctgtgcagtctgccctgggcactcagctctggatatgtgacaacatagagagcgtgggggctaaaaatatgagcaattcccctgaccagggccctggactcacgaatggcccgacgggtcttagagaaagaaacaggcaccctcgagagtgcccccgacccgacccccacagtgccgccagtccctgctcggcctccgccgccttccccaccggcgctgccccggatgttgctggggttctcgagggctgggtggtgcttggacacagaggtctcagcagccgccttggtctcggccccggccctaagtctgagccccaggcaaagggccggactcccagcgtggcccaacctctgctcccctctattctcctcttgcgttatctccaatagaatttgcttgaggtcatacgttttagggtgctcgacctgggccgcggccaccggcatatgctctatacccgcccctccggggggcccaggatctataggtatgggctgcatagccgcagcagactcctggaccccagaggcctctctgataagatgcccgtcggtcagagcccttttggccccctcaaagagagacaggtaataaatctgtagctccccaaccagccctccttcatcgtaaaatcgaagggcggccacgtggaaggggttgtagagctctggaaggccctcatcgcagtacactggcacactggtaaacgtgccccgatggctaggccgtccgggcagcatgccccgagcagcaaacacgcggcagaccctcgtgagacccgtccggtcactgaagagagtctggcaccaggccccctcgcagtttggcacgcgattggggcaaagctctgccataaccgtgtcgggaacaaataggtgcacgaggaggggggtcccgaggccactcaacacttggttgtcaatgtggacatccatagctctctcatgcgtttggctacagcatcatagcgcttgtttctggtggatttaaataacagggccccgtagacagtcttttgtgagtaaatagagatgatgacatggatgtagagactgaggaccacatccaccaccttctcggaggaggcccccctaaacagcatcaggcagcaagggaacacaaaggaaaccagggccgggatgtgaggcctcagcgccccctcctgatcaaagagggcctcgctgaccccggagatgacattctcattcagaaagtagtgatagaggtgattgaccacagtcttaaccaggccctggacttgttcaggctcccacttgtcccgctggtcctgtgtgtcttgtcggatctcggtccagggcctcagcgccggctggaaatgcggccccatgtagttgcctgtaagggcgcacaccactccctcatgggtctcaatcagggtgcactcgctggatccatcacatacgtggtactcgccacagccccagcaggcaaacacggaggccatgctctcaggtaacgggagatggaactccagcttactatacgagcacaggtggcgaggattgggctcatccgtgcccccctccccccgcgggaggctcaatcggccttggtctgacattccaccccggccaggtccaggagggtgcaaatattctccaggcgctgcacctcagagacctcctgctcaaagagacctcccaccgccacgtagacgcgggccaccgtccggggaaggtcagtggggtcccagctcagcaattctccaaattctctctccccaatagtgcctcgcttcttatcctgtctttcagagcatccgggggcagacatttcacctcttgtttgtggacgaggctaactttatcaagaaggaggccctgccggcgatcctgggctttatgcttcagaaggatgccaagattatcttcatctcgtctgtgaactcggctgaccaggccaccagctttctttataagctgaaggatgctcaggagcggctgctgaacgtggtaagttatgtgtgtcaggagcatcggcaagattttgacatgcaggacagcatggtctcatgcccctgctttcgcctgcacatcccgtcctacatcaccatggacagcaacatccgagcaaccaccaacctctttctggacggggcctttagcaccgagctgatgggtgacacctcctcgctgagccagggtagcctgagccgcactgtgcgtgacgatgccatcaaccagctggagctctgccgggttgacaccctcaacccccgagtagccggacgcctagcctcctccctctacgtgtacgttgatccggcctataccaacaacacatccgcatcaggcaccggaatcgccgccgtgactcacgacagggcggaccctaacagggtcatcgtcctgggcctggaacacttcttcctcaaggacctaacaggggacgctgccctccagatcgccacctgcgtcgtggccctcgtctcctcgatcgtcaccctgcacccccacttggaggaggtgaaggtagccgtggagggcaacagcagtcaggactctgcggtggccattgcctcaatcattggggaatcctgccccctcccctgcgccttcgtgcacaccaaggacaagacgtccagcctgcagtggcccatgtacctcctgactaatgagaagtccaaggcctttgagaggctcatctacgcagtgaacacggccagcctttctgccagtcaggtcaccgtctccaacaccatccagctctccttcgatccggtcctctatctcatctcccagatcagggccatcaagcccatccctctccgcgacggtacctacacctacaccggcaagcagcgcaacctctctgacgacgtgctggttgcgctagtcatggctcattttctcgcaacaacacagaagcacacgttcaagaaagttcattaaactttattgactacaccagtcccttgtaaagcgacgggtctcgcgtgacggcattcgtgagcagggcttcgtccaggggcttgttcttggcggacatcattagcccagccgcaaatatcagaattagcatcagaaaagtgagccccacaaacaccagtgtccagagaggaagaccgtaagataaagatggctgcctctcatctggaacggtgggaagctcagcagttgtttttgtggcattggacgtccctttggaggacagcgtgggggccaaggtggtagcgttggtaatacgggtagtagcactggtggtggaggaggacctggtggtgacattgctagtcacacccgtggaggttcctgttccggcctcggtggcagtgatgttctgtgcagtaaccttagtggtgacattgatggtggatgcgttggaagttgttgggactggtgtgacagttgtcccagtgaatgtcaccgtggttgtgttggtgctcagaatagcagttgtggttataggggcgctagtcgtggtcaaggtcgtagactggtttgtgctaggacccgatgccgacggtgatggtgtagtcacagccgttgtgcctgtcacgttccccgccgaggccgtcgaactgccactagatgtccaaataaggcttgtctcacagatgagtatcatggccataacagcgcctgccttgtctctggcgtgtgccatcgcgtctggacgcagaaggcctcccggcctcttttatagctagtctccacacccaatactctactgaaccatcacatacatgacctcctcgaggtatgcagggaatgagcggtccgtgagccggtcaacacgacattgcttccgtttcatgcctccagctgcccctgaccagttaggacccttgacggatgtctttaacggcgcggtgcagttggtcaccaatgacggcctaaaggccaacacatccttgaagcagggcgtaggaatggtaccaaactcggggcccaccccatcaaagacataatatgtctcatagtggcagtgatgatgcatcaccaccacagcactcgccaggaccctctgcatatcttgtacaaggcgcctttcaactcggccactggctctggtgacgttaaatgtcctgttcctattagtcacagcctgtagatttgggcacccagactcaaaaagtgcagctacatgaagggcagccgcctcaaatccaccatgacccccatggctgtccgtgttgttggggtaataagtcacattgttaatgaccacggccgggataagggtgtaaaccttgcagaatggattggtcggacacccataagacaggggcaccccaaaatcacgccccttaccccgaagcaccttggcccccaccggcataaagctgggcaaaaagagtgggttaaaaccaaaggcgagtagggccaggaacgccaaatagcagcagtaatagatgaaaacaaagctcagcatgaaacagcgtggaggctcagctagggtctctgcctctccatcatagacatcttccttgaatctcattctctcaccgcatacctcgctcttcatccaggagggggccatggctgccattctaccagttaacgaggagagagagagtaggtccgcggaaattggtgcccctctctgccctcctgacgaggccatggtgtcatccatctccgcagtccgttcttcagctttggcattggtccgggtccgggtggtctgattttgattctgatcctgggtattggtcttggtctctcctcccccattggcatggattggcataggtgggtgtggctcaggctcaggttccggccctgggacggcagcagccgccgggacggtgaagtcgtggaaggtagaggcccgtccctcccgaggtcgtggggccggagccttataaaagacttccaccctctccccgctggccaagacacgccgctcgtggaccacgccatcttcctcccggctgattgtgtggctgacggtgccgtgttccaccgccacttgttcatcgaccatggtaccccctttatcttaaccagcaagtggccgtcagggtctcttgagagtatgccgctgtggccaagcgaggccccaaattaaatagtgatgccaaagactgtaggtaggtcatcatcacacgcatgcgtgataaatcatccgccactgacaggtcatccaggtctatccgggctatctcatccggcaccatttcctggaagagattcaagaggtcgtgatgctcatgccggataaggcctcggaccaggcgcatactggccctgggcagcagggtcaccatgatgcaaaagtagagactcagattgtccagcagggccaagccaaggggccctggcacctccgggagggccaactcgtagtggtgccccaggtatgaaacagagccaagatgcatgtgtacatcgagcatgtctgcgttcccgggagcctgcatgacaacccgggagtacacgttaaacaggagaatcttctgcagcacctcctctgctatgggcgtaggcagcaccatggggaaaacaatgtccacatcattggactctaacttcacggtggcatgctctcgtccaaataccgggggcataacactgaggctcccggtcccatgccactggaaaaagggctggtacttgttcttaatggcgtaggtctgacctggaacaatcttggtgagtatcaaactgtccacgctaacctcatccagcacggccagggtgcaatcagacaggtagttgtacatggacacgtagtccgggaccgtctctagagagtacacctgacccaagcccaatccctgcacattctgcgtcccgtgagtggaagccaggggtaagatgcagccaatcctctgttgcatcttggcaatctcatcggtatacagacgagaggagagagacactaccactttcaaatccatctttattgacaattatcaaaaaaccaccttatttccaaactttaatattcttcgtaccggcgccacctcttcaattatatagtgtccgtaatggatgggggcgtgggtctgtttgacagacataaactcatcgatgagtgcccgggaggaggctgagagtgcggggaatgcctcctgcagaaagctgcagggctgctccagaaacacgtcagtgccagcaatcactacaaactgcacctctgtgttgctggtggctgggtgccctccaagtcgctggctgtactcgttgaccatgttgtagagtcccctgttgttgcgcagaagctcctccttgttgaaaaatgcccggcaggggctgtagaggcccgggacggccgtctggcgataggaggagttgtacatgatgtcacccagagaacccagctgagatgcccagggattcacagtgctccggtattcataggcggcatccgggcgagaatggtcatagatgagcccctcggcaacctcctgattgtagttttcacaggagaccacacaggcggcccgtccccttggagagttggacttttgaaaataagccacgtctgccgtgaccggtgttacgataatctcacaggtggcctgctggccgtggcagagtcctggagctccattaacattagtcatacctgccaggtatgtcctggggtcccgaagcagcgtcccattgcgctgagcgcccaccttggccttgatgtagtcattgacttgctggttgccaaaggcctcggccggaaagacgctaaagaagtcttgggtgtggatacccatgtcagtagtgatggccgccaccctggccggagtcatggtcgagctataactaagcccggtgtcgatggaggccatctcgtgatgcacctcaaaggttaccgcgtccaccctggcctcccggcggctaacatttggggtcccaatgaacatggatgttgaggccctggagctaaacaatatgttttcagagaggatctcatcggtcctgaccacggtcatggccacccctgggtggatcttgagcttggcctgggcaatataggccatgggggacatcttgatgtgcatggcggtcattccactgattgaaacgagggaaggaagacattcggccgcgtatttgcccatgggcgagcggtgccactcccggtactctgcaaagagctgctctggccggttgaaggcttccacggcccgctgctgaggattgcgcataacaaaggtggcaacatcctggtgcatggtggcagccactcgcgggtccccgtaaaacatatggaaaggaatggcgtgaaagagacactgggtgacggcccgggtcctctcggagaaggcaaaggccaccagcccgttcaccaaaacagtctgctctgtccgcttgtcggcgggattcggggccagctgctgcgtaacgtcattgtccaccgacacacgcacggcacgggtgaaagtggggcaggtcatgaatgaggcgctgaggtccctgatcatgcccacggtggggcggaggtcggagatctccagcagatccctgagcgtcccattctccaaattgtcgaggatgtcctcgtccctggtaaaatggtggctgaaggctggcccgttgtaggccagggtctgggccacgtgctgaaagtccaccccgaggccgcacatgtgggcattggtgcaggttgggaggaaaacgtagtaaaagatcttttccagcacatccgcatgcccctcatctacataagggcctaggtgcagacggaaatcgtggtcgtggtctccgttaacccggtagccgtacaaggccacaaattgggcagccatctcatccatgtttccaaccctctcaataaactggggcgcggccagggtgtcagcgtaaacctcatttccgataataatctggggggcccggtcactaacggtgagaagatgggtgaaaatgtctgtgtaggccaccggggggagcaggttagggtccaggagagcgcagacatactgacccacgctctcatcccccacaacatctgacccggccaggcgcatcagggcctgctctagggctataagttccccatagatttttctatacatggaataggcctccttggagatggcgttatttcccaggtggcggcagatgaacttgatcatggaaaagctgttcacaaaggcaagcctccctgaccgttcccagtaggtgttgatgcacagggacaccaaaggcacgttcatgacaaacttttcctcaaacccgtggatcatagcctcgactacgtagaagaaggctggataggcagtgtcataggcagtatcctgcacagtctcaataacggcctgatccaccacgtgggccagagatgtggcggtctcaaactgctgcccccgggcctcttggaatgcagctggggccaggggagtcggcaggttacccaccattagccggtgcacagccctgtgcctggccctctccccggcatccctgccaatgtaaatatcataaagggggtgcagctccagccgcagcaggtcataattggacgggtggaggaagtcttcggtgggcagcccgcacttgagagctatatctgtcacgggggctgcatacttgttatcatagaactcgtccacaataacaagcacattcatgtgattgggcctcctgtgttgcagggagtaggtctcgcgcctgtctcgcggggccggggccgcgttgaggctgtttagggtatgggcgggtgtgtggagtcgggggtgacagagaaccttgagagcattctgtaggttaaacgcgaggagaaggttattcttgtttacgatccatgcctccaccggtagctgctgtgtggggttgtccagcattttgatggcggcggaggtcgtgtacttgggattgggcataaacaggcccactgggaaatagtagctgtactgcattcttctgttgagggggtatggggactgagtgtcattgtacatcttttgcaggctttccacggccaccgcgtggttgcccagcttgatgacggcggctgagatcggcacccggggctgatcctcgacccctgcggccacagccggcaggtcagacttggtgcttccggctttttccggtgagtccacgatcctagccatgaaatgctcaaacgtacgcatcacgcgcccgtagctcacggcagtgaccaggttctccccccgtaccacaaaagaagcatagctcgagggccccataatctggttgtcggcctcctcacccaggaaggtcaagagctggcgcagaacgttgtcggtgacaataaacaccccccccactggctctccccccttggcggtcgtgtaggtactgacccccttgagcacgctctccccggacacggccgctaccatctcagagagacggcttcgcacgtactgagaaaacccggagcccatgttctcggcccggtccaggaagaaggagtgctccagcagatgcctcttgaacatggcaatgaggtcagacttgacagtcttggagaaccccctctcagtgaaggtgggatccgccagggtctgcaggataaacatgggaggggcatggcgaagcttcacactcaggacggtgttaatgaggcccctctccagggcatcgaccccaaactgtagggccgaggccacggtcttgacagcccccacgtactctgcgtactcgaccggggtctcggggatactatgcaggatctccagatccagcatggacagttccatttccgtactaatgtggtgtttgtggcaatttttgaccacaatgaatgtccgctgcttgctgggtctccttccgtccccgtgagcaatggtggggacggagattcgaaattgaatcttgccatccgtcatacgactcaggtctttgaattccgtgttcacacaggacacggccagtgccgtctccaggaagcgaacatattggatggcgttcgtgtagaccccgagtagcacctcaaacttgatgcccgcctctctggcatccttgcccaccagcaggtcaaagctatgaaacaacccctcagccgctgactgccgcaggttcgagagcaggtcggcatccaccgtcagataggggaagggtctgttttccacaccctcatttgaggccatgacacaaggtaagagggagatggggggaggtctcgagggcttctcttcacagctgggtctcttttacgccctggcctgcaaccgcagcccacccacacttcccgaggatgctacccttctaatcaaatggttggacacggccctgggcagggaggccaccttttacgcgtgtcgggctatgcgtcggcttctactcggcgttatccgaatgaatgactgccaggagctgccacccggtttaataattctgagtccgggcaccgtccctggcccccttggagtccagagtctggagcatacagactgcgaaatatggtcctctgcccaccctgaccacgctgcccacctcccggtgcccagggtcatcacatacaccgactgcccgggttccataaacacgagctcaatgtttcgccttatcatccgctacttgtctcatcaccaatttgagcgctgcttcgagcagttctgccgcgtggtcccgcgtcggcttcctagggacctgtaagcgaaactctgcaaagatgctggctcatctgaatcaggttaccaggatccccccctgtccgcccttcagcgggcgggaggccagactcaagttccacttcttctcctggagcacattcatgctgtcatggccaaacaatgccacactccgggagatcaggacgagggccgccaccaacctcacccaccacccacatctagtggatactctgtaccacgcctctccgcagaccccatttctgacacgcagcggtgctctataccgcttcgtcacctgttgcaactgcaccctgcccaatatctccatccagcagtgcaaggccggggacagaccgggggacctggagatcattctacagagtaacggcggagggaggcccgcgagcttccagttcccctcctccccaactggctccctattgcgatgcatagttgctgcgtccctgctgccggaggtgtccgtggggcaccaggagctgtctccgctgcggtccagaagccagggagggcagacggatgtcaggtcgggcccggacccggcccggagactggtggccctcctgcgaagggaagatggggcacctaaagacccccctctgggaccgtttggacacccccgggggcccggcccggccaagagcgaagacgaggagtctgagcgtcgagacgcccctccacccccgctcgattccagcttccaagcttcccggttggtgcccgtggggcctgggtttcgcctgctcgtgttcaacaccaatcgggtgatcaacactaaattggtgtgctcagagcccctggtgaagatgcgagtttgcaatgtcccccgcctcatcaacaactttgtagcccgcaagtacgtggtgaaagagacggcgttcaccgtcagtctattctttacggacggggtgggggccaacctagccatcaatgtcaatatcagtggcacctatctgagcttcctattggccatgacgtcactgcggtgcttcctgcctgtggaggctatttatcccgcggccgtgtcaaactggaactcgactctagatctccatgggctggaaaatcagagcctagtcagagagaaccgaagcggggtcttttggactaccaactttccctcggtggtgtcctgccgggacggtctcaacgtgtcctggtttaaggccgcaactgccaccatatctcgagtgcacgggcagacattggagcagcacctgatccgtgaaatcacccccatcgtgacgcatcgagaggcaaaaatctcccggattaaaaaccggctctttaccctgctagagctacgcaatcggagtcagattcaagtgctgcacaagcgtttcctggaaggcctgctagactgcgcctccctcctgcgcctggatcccagctgtatcaaccgaatcgcctccgagggcctgtttgatttctccaagagaagcatcgcccactccaaaaaccgacacgagtgcgcgcttctgggtcacagacattcggcgaacgtgacaaagctggtggtaaacgagcgcaagacccgcctggacatactgggccgtaacgctaactttttaacgaggtgtaagcatcaggttaatctaagacagtcacctattttcctgaccctcctgaggcacatccgccgacgtctgggcctgggccgtgcttccgtaaaacgagagattacccttctcctggcccacctgcgcaaaaagacagcccccatccactgccgtgatgctcaagtgtaagcagcccggggcccgcttcattcacggggccgtgcacctgccatcgggacagattgtcttccacaccatccacagccccactcttgcctcggcgctgggactgcctggggaaaatgtacccatcccggccctcttccgtgcctcgggcctcaacgtccgtgagagcctacccatgaccaacatgagggcaccgatcatctcgctggctcgcctcatcctggcccccaacccctatatcctagagggacagctgacggtgggcatgacacaggacaacggcattcccgtgctttttgccaggcctgtcattgaggtaaaaagcgggcctgagtccaacattaaagcctcctcgcaacttatgatagcagaagactcctgcctgaatcagatcgcccccttttccgcatcagagcaccccgccttctccatggttgagtccgtaaaacgagtccgggtcgatgagggagcaaacacccggcgcaccatccgggatattctggagatccccgtgactgtgctctcatccctgcaactgtctcccaccaagtccatcctgaaaaaggcaccggagcccccacctccggagccccaagccaccttcgatgccaccccctatgcccgcatcttttacgacatcgggcgacaggtgcccaagctgggcaatgcccccgccgcgcaggtcagcaacgtgctcatcgccaaccgctcccacaactctctaaggctggtgcccaatccggacttgctgcctctccagcatttgtacctcaagcacgtagtgctaaagagtctgaatctggagaatatagtgcaggactttgaggccatcttcacctccccgtctgataccatcagtgaggctgaaaccaaggcctttgagaagctggtggagcaagccaaaaacaccgtagagaacatagtcttttgcctcaacagcatctgttccacctctacactcccagatgtcgtccccgatgtcaataacccaaacattagcctggctctagagaagtattttctcatgttccctccctcaggcaccattatgagaaatgtcagattcgccacccccatcgtccggctcttgtgccaaggggctgagcttggcaccatggcacagtttctaggaaagtacatcaaggtcaagaaggaaactggaatgtacacactggtcaagctttattacctgctgcgcatctaaaggaaaaacataacaatcttgtgaaccagaaagatacccagagcaaaagcaataaagtacaggattattgccaaaacaacgtgtgctctttcttcatacaggcccgcaatttccatgacagtcccgttggtggtcagcagcagatagtgaacgtggaggttgtcaaaatcaaagtagttggagctcaagatggagttttggacttcctgggaggtgatgtaggttgtagtttccaggccttccttttcatcataactgagcagggcaaagccacaaaaaatgcaggatttctgcgtcctggtaaaattctggatctttggaatctggcggggctccccagccacagcaccctgcgaacatttattcattataacgggggagagaaagagagagctgctgagataggtggtgctggcctcgtatagcgccgagcctcggacctcacggtcactagagattatgaatgtcacattgatgagcgggataatcatcagaactttgtcgagcctgtccacgcatttgtaggcggggagatgccacgcatccctgtcttctcgctccaaagagagccgcccaagaaacccatccacagcatttgaaacggccgcctggtccagcgttgcctcctggggggccatgctcagcagcttgtctcgtgtgaggtcaaatcgtaggctgaggtagcacggtgagaagagcccgctctctgtccccagggctagcccccgcaaaacctccccaatctctagggccgagcacagggcggtggacagcagttggtatagggcaaggttgggcccctgggtagtcacgttcagccgcaactcgcgtagcaccacgtggctgccgataaacagggtctctctcatcacggtatgcaggggctggaaaagggggtggcggttgtaggccgagagaagcacagatgtggcgcctccaatgaggccactgtaaaccccggccttggggtagccgacggtggctaacctcagcgcgtactcctgtttctcagtagtcaggtgacccagctcctccatcttgaccgtggccatcagcatggcggccaagcgctccagcccgtaggattgcatgcccttgacagtggccccataacatatgccgatgatgtctttcaggacagtcagctcaaagaagctcttggccaaccagcggaggtccacgcagccattgccagtctcacccacagcatgacccaccttaaagaaggccacagaaacctcaaacatggtagtcagcgtttccgtgtccagttccggctcccggcagcctcccttcatctccagcaggaccagtttctggagaacgtagcgagcgtagctggcggctgtcatggtgacggctcgggaaaacatatccttcaggttgggtacaaagtagttgtgaaagttggcataatgcacaaaggttgtaacaatcaccagggaatagtccccgctttgggcactggttaaggatgggtaactaaaaggccccctcagatccggcaggtccttcgtcttgccaaagaccaggctcaacacatgctcatctcccttctcggtcactcgcttgtaggtgcccatcagaaatttagaagtcatggcccccgtgtactgaaacttgtccccgttgatggacagggccacataagacaagtgacagcgcagctgataaaagacatagctgtgtggccgcgtgttgggcagcatggtgccaatatagtagaagagctgcttctcaaggggggcactaagcatgcaggcaggggaattcaggccgctaatgactccgggatggaccttagatgcatccacttgcatggatccttcagagacagcagggatatcgacaggctcggccagcgcaataccaagggtaccagacgtcttgtaaattaacttgtagcggttaagcatagacgccaaatcttcggtgacatttgcctctctccacagcgcctctgggctaaggcctgggacctttgccatcagttcggtccatgggatggtgtaatgcgaagcatgcccctctatgtccaggtgcagcttaacctcgctgaggctggcagcccccacctcccatagcaacaccaggcaaaaaacacagagcaactgcatcctagtcccgatttcccctctcaaaatcagagatcaccttgctcagaccagcccaatcgaaaaactgagatcgtattgccggattcttcaatgcctgcatgtaaatctccgtccagcatccaggtaaatcgtcctgaaactctgagaggtccacaagcacaaactgaaggtaggctagcgttcgggtgaacgcaagacaaacttccaacaacaccgcgtcggctcggaaaggctgtatgacttccttaagtacactaaagatgctgttcttatacagcttctcggccacaccacttcgaattatgggggtgtggctttgatgacatactgtcgtgattgttgttagaccggcacataccttcacaatgtcctcgggggcaaaatactgtgttaggagccaggcacagtaaacggcgtgatatgcatcgttgacactcttcaggtagccagcatccagtcctgactcatgtttcctccctcgcttcttcaggcggcgcatgttctcctccacgtttaacttcatccagactatggtgtcccccgggtctgcggtaaacgtggccaaaacttgaataaagtcactataggagagaagctggctccggagcagcattagagggaaaaccacggaggccgacagcaaatggcgatcatgcaaaatccaacaatccaggggcgcgactgacctggcaccagactcggtaaccagcaagctccgcttcctagaggccaagactctgaaaggggtggtaaatttcatctggcatgctaaaacctcagccgacgtgtcttcccttccatgcctcgcccgagtcacattcttgtgcatggccttaatggcattttcatacacatgagtccagtaccgcatcggttcagggactacaatggtcaggtccccaaagacagccttcaaatgattcagcatagtagtctttcccacaccaggggcaccttccaaaaatagggaacaggcaggtttgattactggtacatgatttgttaggtgggtcacaattggaacccgcatgctctccttcctctgagccttggcctggcgggtgtcttgggcatcatccagattcagaacattcatcacactcccacttagccgcttcagctgggcagcatgcttggataacttactaaactcgcgcccatgggcggccaggtgttcgaagagaccagaaggcttacccttgccaccattcttttgttttaacgcggaatgagaagagggcctgcggaaattagactcatcctcagactcacagtcagatttgtcatcgagcccaaggccggccaggccctcctcaaagcctttctggtacatgaagctccggctcgtggagtccgcacctccttctgtgcacgaagttttgcggaaccaggagaaggggtctggcgtcttgctggggccacactcccggctacggggcttcggggtaggggcagtaggcttttggtgtgcgggtgctggtggctgggctcccctgggcagggtaaaggggcacgatgtgtgccggctacccggagagtttccagtattagatgtcacggcagcctgggtccggcacggcaccctctccccagacagtccggtcggagccatcaaggggggccagtgggtgggcacctggtagaggccgtcgtcatcttcctcacctgcccctgagtcactaccggttggggtaagaactgagggggcaaagtcatcaatctcagcgtaaaagttttcgtgtctttcgttttcaggggactcatcctcctgacattttcgccagccgccgggcgggccggcctcctttcctggaaatccagccatggatcccacccggggtctgtgtgccctctccacacacgacctggcaaaatttcacagtcttcccccggctagaaaggcggcaggtaagcgagcgcaccttcggtgttactccaagctgctctctcttaagagctgggagcaactggcctcttttttgtctctgcccccgggacccacgtttacagactttagactatttttcgaagtcaccctgggtcggagaatcgcagattgcgttgtggtagctctgcagccttatccccggtgttatattgtagaatttaagacggccatgagcaacacggccaacccgcaaagcgttactcgcaaggcacagaggctagagggcaccgcccagttgtgtgactgtgccaattttcttcgcacgtcctgcccccccgtgctgggcagtcagggcctggaagtcttggcggcgttggtatttaaaaaccagcgatccctgagaacgctccaggtagagtttccagccctgggccaaaagaccctccccacctccaccaccggcctgctaaacctcctctcccgctggcaggatggcgctctccgggcacgtcttgatagaccccgcccgactgcccagggacacaggccccgaactcatgtgggccccaagccttcgcaactcactgcgcgtgtcccccgaagcgctcgagctggcagagcgggaggccgaaagggccaggtcggagcggtgggacaggtgtgcccaggtgctcaaaaataggctgctccgcgtggagctggacggcatcatgcgtgaccacctggccagggcggaggagatccgccaggacctggatgctgtagtggccttctctgatggcctggagagcatgcaggtcaggtccccctccacgggagggcgctctgcgccagccccgccctccccatccccagcccagccgttcactcggctcaccgggaacgcccagtatgcagtctcaatctctcccacggacccccctctgatggtggccggcagcctggctcaaacgctgcttggtaatctgtacgggaacatcaaccagtgggtaccgtccttcggaccctggtacaggaccatgtcggctaatgccatgcagcggcgcgtgttccctaagcagctgaggggcaacctgaactttaccaactccgtctccctaaagctgatgacagaagtggtggcggtgcttgagggcaccacccaggactttttctcagacgtcaggcacctgccagacctccaggctgccctgatcctctcggtggcctacctgctactccaggggggctcctcacaccagcagcgccccctccctgcctcacgggaagagctgctggagctgggcccggagagcctagagaaaatcatcgccgacctcaaggccaagtcacccggcggaaattttatgattttaacaagcggaaacaaggaagcgcgccagtcaatagcccctctcaaccgacaggcggcatatccacccggcacattcgcggacaataagatttacaacctgtttgtgggagcgggactactgcccacgacggccgcgctgaacgtgcccggggcggcgggtcgggaccgggacctggtgtaccggatcgccaaccagatctttggggaggatgtgccccccttctcatctcaccagtggaacctgcgcgtaggtttagccgcactcgaggccctgatgctcgtctacacgctctgcgagaccgccaacctggccgaggcggccacccggcgtctacacctatcgtccctgctcccccaggcaatgcagcggcgcaagcctgccatggcgtcagctggtatgccgggcgcctatccagtccagacgcttttccgccacggggagctcttccgcttcatctgggcccactacgtgaggcccacggtggcggcagacccccaggcctccatcagctctcttttccccgggctggttttgctggccctggagctgaagttgatggatgggcaggctccctcccattatgccataaacctgaccggacaaaagtttgacaccctctttgagattatcaaccagaagcttttatttcacgacccggctgccatgctggcggcgcgcacacagctgcgtctagccttcgaggacggcgtcggtgttgccctggggcgcccctcgcccatgcttgcggcgcgggagatcctggagcgtcagttctcagcctcggatgactacgaccggctgtacttcctgacgctgggctacctggcctccccggtggccccaagctgagccagttcctcgcactggagtgggtcattggcaaaaaggtaaataaactcatcgcacgggggttttgcctccttctcgtctcttgtttcgggtaggggagtaaggccgctgccaggccgccatgctcagggccacggcgtgccagaggccctcgtagtcgtgcgcatccgagaggatggcacggtccagaagcagatagccggccaggcagaggaaggccacaaagagggggcgaaggcgtgcccgaacccgggtttcatgctcgtctgcaccccagtggacaaggcagtagaggacacccaccaccaggcggttagggaggacactgccaaggttgaagagcagatttccgtcagccagggtgacctggctcaggtccggcgccctgcgagtccaagctgcgcccacacacatgcacagacggcccctgtgacatcaggccggtcatgcaaaaacagacaaagagaccgtgagcggttaccggggcgcagggcctctgccgggaagcccacccgggccagggcccggtaaagcaggtaccagtattcatccggcaccttgcgtgccaacacacgattcgtgcggtttccagtatttatcacggcttcccgccacaggtaaaagttaacacttagggtcagcagcttggtcagggataggtgcaaaaacctgagctcgtcctcgcgcagagcgcaaagcggccagttctttagcatcttcaggaggagcccgtgaatcccaggtgtcattcgcgcgtcatccccgcgcacccccagtcccattaacatagcgggcacaatggtgcaggcaccgtctgtatacgtctgcggcttcgtggagcgcccggacgccccacccaaggacgcctgccttcacctggatcccctcaccgtcaagagccagctccctctgaagaagcccttgccactcacggtggaacacctgccggatgctccggtcggctcagtctttggcctttaccagagccgagcgggtctctttagcgcagcctcgattacctctggggacttcctgtccctgctggactcaatttaccacgattgcgatattgcacagagtcagcgcctgcccctccctcgagaacccaaggtggaggctctgcacgcctggctcccctcactgtcactggcctccctccacccagacataccccaaaccaccgcagatggaggcaagctgtccttctttgaccacgtgtctatctgtgccctgggtcgtcggcgcggcaccacggcagtctacggtacagaccttgcgtgggtcctgaagcactttagtgacctggaaccgtctatcgccgcccagattgagaatgacgccaatgccgcaaagcgtgaatccggatgcccggaagaccaccctctgcccctcacgaagctcatagctaaggcaatcgatgctggatttctgagaaaccgcgtggagactctgaggcaggacaggggtgtggccaatatcccagccgagtcgtatttaaaggccagcgacgccccggacctacaaaagccggacaaggcacttcagagcccaccaccggcctccacagacccagccaccatgctatcaggtaacgcaggagaaggagcaacagcctgcggaggttcggccgccgcgggccaggacctcatcagcgtcccccgcaacacctttatgacactgcttcagaccaacctggacaacaaaccgccgaggcagaccccgctaccctacgcggccccgctgccccccttttcccaccaggcaatagccaccgcgccttcctacggtcctggggccggagcggtcgccccggccggcggctactttacctccccaggaggttactacgccgggcccgcgggcggggacccgggtgccttcttggcgatggacgctcacacctaccacccccacccacacccccctccggcctactttggcttgccgggcctctttggcccccctccacccgtgcctccttactacggatcccacttgcgggcagactacgtccccgctccctcgcgatccaacaagcggaaaagagaccccgaggaggatgaagaaggcggggggctattcccgggggaggacgccaccctctaccgcaaggacatagcgggcctctccaagagtgtgaatgagttacagcacacgctacaggccctgcgccgggagacgctgtcctacggccacaccggagtcggatactgcccccagcagggcccctgctacacccactcggggccttacggatttcagcctcatcaaagctacgaagtgcccagatacgtccctcatccgcccccaccaccaacttctcaccaggcagctcaggcgcagcctccacccccgggcacacaggcccccgaagcccactgtgtggccgagtccacgatccctgaggcgggagcagccgggaactctggaccccgggaggacaccaaccctcagcagcccaccaccgagggccaccaccgcggaaagaaactggtgcaggcctctgcgtccggagtggctcagtctaaggagcccaccacccccaaggccaagtctgtgtcagcccacctcaagtccatcttttgcgaggaattgctgaataaacgcgtggcttgaaagtaaactttattgcgtgttagtacctgtccattcacaggggtatccagcccttgcgccgcctcccccagcccgccagccaccccagacaggagatgataatgatgaggagcaccggagccaccacagcacaagtgattaggagcagggcccagtgcacccaggtggtcttagggcgccagggatcgattggaaaagggcccagggtcactggcttatgcgtgggacgtttagaaacaggccgcctatggggcctgtgactggtgcttgtggtgtgggagactaatgtggtgggggctatggtagtggctgggataacagtaagatgcatacgctgagtgagggtccggttggcatggtattggtcgtcttcttcccctgcagagtaattgcagtggaccccggaggccacactgcaatttctcagtgtcacattgcacgtgtagtaacctgcatgcgcaagggtcacattggggattatcagagagacggaggtgttggagtcatttacccattctagggtaaggctataattgtaacccccgttagttatatgagttccgttgttggaagtagctacggccaagggcagttgtccatccccgggagtgtatccccggcccaactcgatccgagagaccgactcattgctaggaacgctgcaggtgagattcactctagcacctgcatgggcggtgacattttcaaatttaaccagatctgagaaaaatgcacaaacagaccccacacagcagcacaatagaagcactaaatgagtcattcctaaactgtcagttttaaaactccctgcttctcaggcctaaatatgtggtggggtgtgcttaggatcactttcatattctgcaacaacagccatacccggaagaggagctgccggttgccatttttcaagctgctaaaccacgagtggcagcaggcctaagaagctcctcagcaacatggagacctcgaagggaaactggcaggagcagggagtcacgtaggcactagcctcttcatgtgaggtaagagatcgctaaaaatgggatcagggtatgtaaaccgagttttgcgggggatggtgagccagacacggcgggtgggggaaggagctgacacgattgagtagaaagggccaaaaatacaccagctataaggaattgctcaggccaaagttgttcctcaggtggctttaggcctaatgtaggcaattgcgtgcctagaacattgctaatgtgccctgggtttcctgccttcatgcaaatattctacctcccccggcctggtgcaaaatgtctgcctcagaatactaacagctaatccaagctaacattctatcagtaaacgggcagaaaactgataaggaccgcggagtttggccctccgcggtgtccggtggtcctcacacgtgccctccccccgggccgatggctgaggcccggaatatgcaagtgcatctttctaaccagtaggggcctccacctaggtgctttgttaatctttagtgggaactagtgggagtgctgtgcctcgggtacccctatcctataggtcctaccggagctccttgtcttgataatccctgtaaacacacaccacctaagaacaaggcattgttaacctttggtggaacctagtgttagtgttgtgctgtaaataagtgtccagcgcaccactagtcaccaggtgtcaccggaggctacttgcctcagtgccacttttaccttctcaaatctatacggggggggggggggctctgtaacatttggtgggacctgatgctgctggtgtgctgtaaataagtgcctagcacatcacgtaggcaccaggtgtcaccagggctacttgcctcggcatctcctcaccggagaaggggttaacaaacccgtggggggtcttagtggaagtgacgtgctgtgaatacaggtccatagcaccgctatccactatgtctcgcccgggctatatgtcgccttacctcccctatatagtcacgaccccaccgaaccaggcatgatgtagaataaaattttatgcatcatcttctaatctgtgccgcttggagggaaacatgaccacctgaagtctgttaaccaggtcagtggttttgtttccttgatagagacacaaggactgccagccccattggggagggggggtgggtacgggagagtttgggctcgtttaaacaaagtctcatctgatgctctgtggcacctcaaggtgaatatagctgcccatcgacgtatcgctggaaaccggtgggccagggcctggccgcacgggccatcgatgcggatccagacatgataagatacattgatgagtttggacaaaccacaactagaatgcagtgaaaaaaatgctttatttgtgaaatttgtgatgctattgctttatttgtaaccattataagctgcaataaacaagttgcccgggcccgagtgcgtgggcatgacaatcgtgccctggggaccaacacaatccagaagggcctgaatcactgcgaccggccctcccgcgacccagccgagcgagcttagcgaactgtggacgagaactgtgccaccaagcgtaaggccgttctctcgcatttgccttgctaggctcgcgcgagttgctggctgaggcgttctcgaaatcagctcttgttcggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtggagggcccccccgcagatctgagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccaagcttctcgacagcgacacacttgcatcggatgcagcccggttcgcgttaagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatcagttatctagatccggtggatcccgggcccgcggtaccgtcgactgcagaattcgaagcttgagctcgagatctgagtccggacttgtacagctcgtccatgccgagagtgatcccggcggcggtcacgaactccagcaggaccatgtgatcgcgcttctcgttggggtctttgctcagggcggactgggtgctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcggctgaagcactgcacgccgtaggtcagggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcaccatggtggcgaccggtagcgctagcggatctgacggttcactaaaccagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaaacgtgccggcacggcctgggtaaccaggtattttgtccacataaccgtgcgcaaaatgttgtggataagcaggacacagcagcaatccacagcaggcatacaaccgcacaccgaggttactccgttctacaggttacgacgacatgtcaatacttgcccttgacaggcattgatggaatcgtagtctcacgctgatagtctgatcgacaatacaagtgggaccgtggtcccagaccgataatcagaccgacaacacgagtgggatcgtggtcccagactaataatcagaccgacgatacgagtgggaccgtggtcccagactaataatcagaccgacgatacgagtgggaccgtggttccagactaataatcagaccgacgatacgagtgggaccgtggtcccagactaataatcagaccgacgatacgagtgggaccatggtcccagactaataatcagaccgacgatacgagtgggaccgtggtcccagtctgattatcagaccgacgatacgagtgggaccgtggtcccagactaataatcagaccgacgatacgagtgggaccgtggtcccagactaataatcagaccgacgatacgagtgggaccgtggtcccagtctgattatcagaccgacgatacaagtggaacagtgggcccagagagaatattcaggccagttatgctttctggcctgtaacaaaggacattaagtaaagacagataaacgtagactaaaacgtggtcgcatcagggtgctggcttttcaagttccttaagaatggcctcaattttctctatacactcagttggaacacgagacctgtccaggttaagcaccattttatcgcccttatacaatactgtcgctccaggagcaaactgatgtcgtgagcttaaactagttcttgatgcagatgacgttttaagcacagaagttaaaagagtgataacttcttcagcttcaaatatcaccccagcttttttctgctcatgaaggttagatgcctgctgcttaagtaattcctctttatctgtaaaggctttttgaagtgcatcacctgaccgggcagatagttcaccggggtgagaaaaaagagcaacaactgatttaggcaatttggcggtgttgatacagcgggtaataatcttacgtgaaatattttccgcatcagccagcgcagaaatatttccagcaaattcattctgcaatcggcttgcataacgctgaccacgttcataagcacttgttgggcgataatcgttacccaatctggataatgcagccatctgctcatcatccagctcgccaaccagaacacgataatcactttcggtaagtgcagcagctttacgacggcgactcccatcggcaatttctatgacaccagatactcttcgaccgaacgccggtgtctgttgaccagtcagtagaaaagaagggatgagatcatccagtgcgtcctcagtaagcagctcctggtcacgttcattacctgaccatacccgagaggtcttctcaacactatcaccccggagcacttcaagagtaaacttcacatcccgaccacatacaggcaaagtaatggcattaccgcgagccattactcctacgcgcgcaattaacgaatccaccatcggggcagctggtgtcgataacgaagtatcttcaaccggttgagtattgagcgtatgttttggaataacaggcgcacgcttcattatctaatctcccagcgtggtttaatcagacgatcgaaaatttcattgcagacaggttcccaaatagaaagagcatttctccaggcaccagttgaagagcgttgatcaatggcctgttcaaaaacagttctcatccggatctgacctttaccaacttcatccgtttcacgtacaacattttttagaaccatgcttccccaggcatcccgaatttgctcctccatccacggggactgagagccattactattgctgtatttggtaagcaaaatacgtacatcaggctcgaaccctttaagatcaacgttcttgagcagatcacgaagcatatcgaaaaactgcagtgcggaggtgtagtcaaacaactcagcaggcgtgggaacaatcagcacatcagcagcacatacgacattaatcgtgccgatacccaggttaggcgcgctgtcaataactatgacatcatagtcatgagcaacagtttcaatggccagtcggagcatcaggtgtggatcggtgggcagtttaccttcatcaaatttgcccattaactcagtttcaatacggtgcagagccagacaggaaggaataatgtcaagccccggccagcaagtgggctttattgcataagtgacatcgtccttttccccaagatagaaaggcaggagagtgtcttctgcatgaatatgaagatctggtacccatccgtgatacattgaggctgttccctgggggtcgttaccttccacgagcaaaacacgtagccccttcagagccagatcctgagcaagatgaacagaaactgaggttttgtaaacgccacctttatgggcagcaaccccgatcaccggtggaaatacgtcttcagcacgtcgcaatcgcgtaccaaacacatcacgcatatgattaatttgttcaattgtataaccaacacgttgctcaacccgtcctcgaatttccatatccgggtgcggtagtcgccctgctttctcggcatctctgatagcctgagaagaaaccccaactaaatccgctgcttcacctattctccagcgccgggttattttcctcgcttccgggctgtcatcattaaactgtgcaatggcgatagccttcgtcatttcatgaccagcgtttatgcactggttaagtgtttccatgagtttcattctgaacatcctttaatcattgctttgcgtttttttattaaatcttgcaatttactgcaaagcaacaacaaaatcgcaaagtcatcaaaaaaccgcaaagttgtttaaaataagagcaacactacaaaaggagataagaagagcacatacctcagtcacttattatcactagcgctcgccgcagccgtgtaaccgagcatagcgagcgaactggcgaggaagcaaagaagaactgttctgtcagatagctcttacgctcagcgcaagaagaaatatccaccgtgggaaaaactccaggtagaggtacacacgcggatagccaattcagagtaataaactgtgataatcaaccctcatcaatgatgacgaactaacccccgatatcaggtcacatgacgaagggaaagagaaggaaatcaactgtgacaaactgccctcaaatttggcttccttaaaaattacagttcaaaaagtatgagaaaatccatgcaggctgaaggaaacagcaaaactgtgacaaattaccctcagtaggtcagaacaaatgtgacgaaccaccctcaaatctgtgacagataaccctcagactatcctgtcgtcatggaagtgatatcgcggaaggaaaatacgatatgagtcgtctggcggcctttctttttctcaatgtatgagaggcgcattggagttctgctgttgatctcattaacacagacctgcaggaagcggcggcggaagtcaggcatacgctggtaactttgaggcagctggtaacgctctatgatccagtcgattttcagagagacgatgcctgagccatccggcttacgatactgacacagggattcgtataaacgcatggcatacggattggtgatttcttttgtttcactaagccgaaactgcgtaaaccggttctgtaacccgataaagaagggaatgagatatgggttgatatgtacactgtaaagccctctggatggactgtgcgcacgtttgataaaccaaggaaaagattcatagcctttttcatcgccggcatcctcttcagggcgataaaaaaccacttccttccccgcgaaactcttcaatgcctgccgtatatccttactggcttccgcagaggtcaatccgaatatttcagcatatttagcaacatggatctcgcagataccgtcatgttcctgtagggtgccatcagattttctgatctggtcaacgaacagatacagcatacgtttttgatcccgggagagactatatgccgcctcagtgaggtcgtttgactggacgattcgcgggctatttttacgtttcttgtgattgataaccgctgtttccgccatgacagatccatgtgaagtgtgacaagtttttagattgtcacactaaataaaaaagagtcaataagcagggataactttgtgaaaaaacagcttcttctgagggcaatttgtcacagggttaagggcaatttgtcacagacaggactgtcatttgagggtgatttgtcacactgaaagggcaatttgtcacaacaccttctctagaaccagcatggataaaggcctacaaggcgctctaaaaaagaagatctaaaaactataaaaaaaataattataaaaatatccccgtggataagtggataaccccaagggaagttttttcaggcatcgtgtgtaagcagaatatataagtgctgttccctggtgcttcctcgctcactcgagggcttcgccgtcgctcgactgcggcgagcctactggctgtaaaaggacagaccacatcatggttctgtgttcattaggttgttctgtccattgctgacataatccgctccacttcaacgtaacaccgcacgaagatttctattgttcctgaaggcatattcaaatcgttttcgttaccgcttgcaggcatcatgacagaacactacttcctataaacgctacacaggctcctgagattaataatgcggatctctacgataatgggagattttcccgactgtttcgttcgcttctcagtggataacagccagcttctctgtttaacagacaaaaacagcatatccactcagttccacatttccatataaaggccaaggcatttattctcaggataattgtttcagcatcgcaaccgcatcagactccggcatcgcaaactgcacccggtgccgggcagccacatccagcgcaaaaaccttcgtgtagacttccgttgaactgatggacttatgtcccatcaggctttgcagaactttcagcggtataccggcatacagcatgtgcatcgcataggaatggcggaacgtatgtggtgtgaccggaacagagaacgtcacaccgtcagcagcagcggcggcaaccgcctccccaatccaggtcctgaccgttctgtccgtcacttcccagatccgcgctttctctgtccttcctgtgcgacggttacgccgctccatgagcttatcgcgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacatgagaatggtcgagttaaacatgcatccttaaggccgagacgggcagccggagcttgtggtactgtccctccggcaggtggagtgggacacagttagagaacattagtcctctggtccctatctccacccgccaggcctgtgtgtcagtttgcagggccatcctcgcactcaggtggactggctaggcacccttctgaagtatctggcggtgactgtcacctggttcttgagagagtccataaaatggctgaagctccaggcgtatagtataatgagcaacagggccaaacaggcggcggggcctgggtagtagcgggcaacgagagactctgtgcaatcaaaccccaggctcccggcctcacccaggaagagcagcggcagggacagcataaaccaggagaaggcgcaaatgagtccggtgaaggtgacgttgcatatcaggcgcggcttccttccgaattttgtgcgcaaaagtttccagatgatgataactgtgaggaggacgatcaggactgccgccagtaggtagcagccggctttcagtccttggacggccgtgtgcatgcctttggtggggccttccctgcacatgttggggcctctgttgagattggcgtcggggcccatggtaatgaggaggatgataatcagcaggagtaccagacaaaacacgcccatcaggtacaggcacacatttctgtgggaggttctcttgggcgttcggctgaacaatgctagggtcttctccaacgccatacccaagtgagtccatacggagcacatcaggcccaagaacatcatgttctgggtcaaaaggcagagaccggtagacgagaactcctgaatcatttttcccagcacccagagcagcagttctatgagaagagctatcagccagacatccattcggtgaaccaattttcttacaaagatgataaacaagatgccagccagtgttagcagaatcagcaggacgagcagcaggcttgtcatgccgctgaggaaggcgctgtaggatttagtgcacgcatcttccgttgcattgacggaagtcatgttggccaccagggtccccacggtggacccgggggccatggtggagagcatcttgctggtcagagccagactgggtggtgtctgcagcaaaagaggaacttgcccaggcagtcagttattttgcatgccacctccctgcctggtggacttccagactattttctgcattcgcccttgcgtgtccattgttgcaaggagcgatttggagaaaataaactgtgagtttcacagatccacgggccacgctcccctgggggcttcatgatcccaccgcctttcccgatgatgatgacaaccgcggctgtctgaagcggctgacgaaatcggttgagattctgatgagaggcttgggggggtctttgccctcaaggcgaggctccttctcctaggaatgccgagccccctgcactagcttcgctccactggggatctttgccagccttcatactagattcagcgatcccccggttgggaatcttcgccagccccccgtcctgctatcccgctcgtcgccgcgcctcccatgctaagggcccccttcctttcccttgactttggggatattcggagtctgctctcgccgctctcttctctcgtttaaacgagagaatagtagtagggtccagtctcaggccccctcactttgggtcttagaatggtggccgggctgtaaaattctggaggacggagagggcggccccggagttgttatcaaagaggcactggaggatgttggccgctccttggagcagcttgtcgaaataatgatccacggccacgggaacgccgtgccgctcggcgtaggccgggtcctcggccatctccgtctttctcgcccccttcactccccccttgggctccacaaagacgtactggatgcggtcgtggatctggggcagttcctcgttgcgctcgacgaacttctggtagacggccaggtgaggcatctgggtgctcttgtaggctgagagcttgcggctgagctccgttgaaaagcagagctcccccatggggaccctgccttcacggaggtctgtgtaggcctggtttaggatgtcaatgacgggcaaaaagcccacaggtagcccttgtgtaaatgactcttggaagggccggtgggagaggaggctggccgcctcctttacccgggcatccgccagcaccaggtcgagcacgcgccggcagcgtgtctgcacaaacttgcaggccgtcttccggacgagctccacccccttcatcagggtcttgccgtccgtcagcacccccacatatctcttctttgtaatcagcatcaggcaggagaaggtcttctcggcctccagggagatgggggccacaaacaggctccgggtggtgtgggcggccagggcatcggcaaagcgcagggtctcgctctctgaaaacccccggcactcgataaacagcgagtccgtgtccccgtagatgactcgaagctggccctcggggttgaggggcgcccaggcgtccggggagggggccagggcctgcaggttggcggggctcagggcctccacgaaggccttggcccgctccaacatcgtgcggccctgcagcgtcaccgtctcggcgatggagaggcagggaaagaggccgttggccaccccggtgaagccgtagacggcgttgcacgtgcacttgatggccagctgctgcttgtcgaggatggtcctttggcgcggatcctcgcaggccgccagcagcttcttgatggccttgcgcttggccagccaggaggtcaacagactagccaagaaggactcgtgcacgtgcttctttacaaagtggtagacgccccccgtgagcctgaaggactcatagtcttctcccgggcgcaggccggctagcctgtgctcttctcccggcgttatcatggtagaataacagagattatgagcctgaatgatgctcgggtagaggctggcaaagtccaccaccagaaccggggagttgtagaatccggacaggggctggatgacggtggccccctggtagccgtcccggtcagaggccgagggcatgggcaggataaagttttccttttgggcggccgccaggaggcaggagaacacgcggatctgctgcccatcgtccagcacccgcctgcaggggatgtgagcgatcttggcaatctctgccacctccacgtggatcacgaaatggtttagcagatccatgaccagggccgagtcctgcacgcagtacatgccgagccgcctgcgcccctcggggcccgctgcaaagaggcgaggaatctccttgtaatgcacatcctccttcttggcccccagtaggtgcctggctactgtgtccagcttgtagtctgagaggctgagcttgtcccggcacacggcgtacatgtcgatggggatgaggccggtgatgcggaccttggtgttggcccgcaagaagcccttgcccgcatcatggggtcgcctgacctcgcagacgcccccagccctaattttgcccagagaggctgggttgatgctgtagatgtgcctggctctgtccagaatgtagggccagtcaaagttggccacgttgtagccggtcacaatctccacgctgaggtctctgatgagctggaagaaggcgtagagcatgtccagctccgatgggaactcgtagacctcaaccccctctatgtcttcgcaggtgcccagcgtcagcaggatgcgcctatagcgcccggcctcctcccctgtcgaccagaggacgcaggatatctgcaggatcaggtcagcctcgttggtggccgtggggaagccctcctcccccagacactcgatatcgaaggccagggcctggtaggagggccaggagctgtcttcacgccggaccgagaggtcgcccacctcacagtcgtactcgagctcggcgtacgagtcccggtgctggaggcgggggatggcgcggcggcagctgtaccagccaaaggtgacaaagtcattgtccaggacaaagcggcgcgtggcatccacgttggcctcaaagatccgacacccgtgcttgtcttgcagccacgtggccacgtgacacacactgttgggatgggagagggtgatcttgtggtagtcgccggcatggttgccgtagcccataatggaacggcgcgtgaccttctccaccgagacccggcagggggtcctgcggtcgaaggtgctggccttgagggcgctgaggactgcaaactccacgtccagaccctgaggcgcgctggcgtagaagtaggcctgctgcccaaacacgttcacacacacgctggccccatcggccttgcgccggcccagtagcttgatgacgatgccacatggcaccacatacccctgtttatccgatggaatgacggcgcatttctcgtgcgtgtacaccgtctcgagtatgtcgtagacatggaagtccagagggcttccgtgggtgtctgcctccggccttgccgtgccctcttgggcacgctggcgccaccacatgccctttccatcctcgtcaccccccaccaccgtcagggagtcttggtagaagcacagggggggctgaggcccccgcacatccaccacccctgcggcgcctggtgtctggaaacacttgggaatgagacgcaggtactccttgtcaggctttttcagaaggcctttattaggtcttaggaaagggttatagaagagtcccccagacatggttaaaactcagtctctgcctccccaagcagtgcggcggcggtctctggatcgtgatagcgtcttctgcgtaggcctggaaaacggtccctggctgcctgcaatgctctgctggccactgagggtccggccgccctctgagctgctctcttttgctcctggttttgctcatgcagcgctaacatgatggcttgtaattctgtcttactaatgggattaatgcctggaccctcaccagaggcatgttgctgagcgagctcgtcgatcccggggtagagcatctgcaccggctgctgcgacatctggcgcgtgcgcctcgtgagggaaataaccaggatcaccacccccgccaccaggaccagaatgagcatgccgccgaaggggtttttgaagaaggagatgaaaccagagaccaggctgctaaacaaaccccccaccgtgctgactaggttggtgatggactgacccacgctacccagactgtccataagttcccccaggccgtccacgaattgatttcttccgtttgacactgcattgtccaaatccttccgcaggccggcgatgttttgcgcctggaagttgtactcccggaagatgccctccaggtcaaagacgttggaggcacgctgttcgtcccgtgagtacagctccagggaggcaaagtcaatgttctcgatgagggaggtgtttagtgagatgaaggtctgcagggtggcaatgccgtccagctcgatggttttaaagtggtggtagtcgttgtagacgtggatctcgttgccggactggaagtagtactggctggtcgcctggcacacctccgtcatcttttttgtgaggaagatctcgttgtcggtgcccagctgtccctcgtaggtcttggtgtcgttgataaagctgaaggacaccagggggcgcgagtagcacatggtctcggagccagggaccctcatgctcttgcgcagggtgacggtggcctggttaacgggcacgcactgggagactgagatgacatcccccaggcgcttggccgccaccgccttaccgtagatgctggacatgacggtggttggattaatcttggttagttctctcagcaccatgttctgcctcttctgctccaggcaccaggcccgcgcaaggtctcccagcatgcggttgatctggcggcgcagggagtcgtaggcaaattggatctggacggtggcgggattgttgagggtgcccagggacttcccgggggccgtggggggcaccggtgtggtggcgttccccgcatcccgcctccgacgcctcagaacggcggcgggggtgctcccgcgggccgcggatggggctgggggcgatggactgctggggggtgaggaagtcggagtggtaagctccgtcaggttcttgacggtggccaacgagcgcggggtcagaggtagccaagctaataacaatcctccgctcgttataaaatatgtaatggcttcctggcccttcgtgtaacgatcctggacggcctcgtacttctcatgcatggtcttgttcacctgctcttcgatgcacttgaaggcgtccgggagctctatgcccacggttgtgttggtcacgaagctagaggtgccctcgtcagtcacaaaatgtattgacttccctgtttctgtggcgatggtcgagtcaaaggtttgccagtgttgaagcgggcagtaggctgtcctgttctcgagcttccaagatagcgtgtaagtgcccttgtccaggaaggctcggcgttcgccttgcgggttcgtccctcggttgtcgtagtccactatcttgtagttagttctcacgtggaaggagtctgcccgctcatggaaggtttccttatttttcccgtcatagaaaggggacatttccacagtctgcccggtggtggtcacaaagaagtcgaaggggctgttggacttggccatcatgtcagttatcaggcagttgacggtagttcttgttctgtaagtccatatcaaccacccgggggcgtcatagagctccgtctggctggcgtagcggcgcaccccgttggccaggcccccggtgggctttaggttgacggtgatgttaactccgtcgcggtctacatacacgcgcgtcagcccatcttttgtcatcttgaccgcgttgtagcactggtagatggtatccatctggtcagtttcgtagctgtcaacggagaacttctcctcgtgccggttggtcacggagtccgcgtaccagccattgtagatgagaatgttggtcactatcttggtgtaggagcggaccttaaacgagtagggaataatgttgtctttaaacaccatcaacaggccctccgtgtgattctcccgcgtgccaaacgagggacactggatgtccgaggagaagcggaacaggtcgccgtggctggagagctcgcagactcggaaaggaaagctggtttgctgacgcgtggcggtaggctgcaccgtggtggcggggggtgcgggctgctctggggtctgcgcaccgagacggcacgccagggcggctagcagcacgaccacgcttagcaccctacgccgagtcatctctcatttggaggtgcaggtagagaagggcatatagatccttaaatacccaccccctgcccttatacagaagaattagggggcggtcagagtcgtacgtgaggtaaagcccatccgggggcagggcctggccggggctgaccgcgtccgcccggcgcaggatcaaggaccgcccccaggtcttgttgtagagggacacggttaggacggcctcgcgcagcgcccggcacagaatttgctggctagatgccagtgagcccccgggtacgctgtagaagctgttgaaggaggtctctatccagtcgctcggctcgatgcctggccatatcagggaagtcaggaatgccttctggtggggcagcgtacctgcggcgtcacagcagcgagccagggccacgttgctgggtgggggaaagagcccgctctcctccgccaggggccccgtgatgaaggtgtacaggctgtgcgtcagcgcgtgcaggtgctccgagctcagggtctgggtaaacaggtgtgttttgatgtacttggaattctcaaaggcggcaccctcgccggcgcgcctgtcctcccagggacccgagacgaaggcccgtctgtagaggaagtggttgcgcatgcgggccagctcccagtagaccacgtccccccagacgcgcaggcacagggtctcggtcagggtctcgctctgttgcgccaggcaggactgcagcttggccagaccctcggtggccacctggcgcaggtactgctccttgcgcttgagcgcgtccgagagggcgccggacgggccgggctctcgtgccccagccggccggggcacctccgggctctcccgggacgcctcctcctcgcctcggcccaaccgctgcatggctcggttgagccgcgtgtacagctcgttcctcttttgcaggatggcccggtactgggggtgcgccgtgaaggcggcggcgcagtccgccttcagcgcctccaccgcgtcgcccgaggagctgtagaccccgccgcagaagagccgctccgtggccccgggagccacggcgtcaaacaggtgagtcagccttgcccccgccagcgcctcctcgcaggccccccgcaccagggccaggcgacgctcccgggcaaacagggcagagaggcgggaatggccgccaccctccccctgccccgttgcaccgatagcatggccgccagagttccaatagaggagctccgagagctccgccacctccgggggcactgtcgagaagacgttgtaggtgtccagcgctctggtcgccccctctgcctccggccgccccgggcccgggaccgcgccctcctctgggccgcccggcctcgccttctcctcagcctccaacaggtgcccgagccccgcctggcggacttcattctcaaacagtcccgagaccggctccggattcaccggcaccgccaggtggttacaggagacgtgggtcccctctgccgtggaagggttgccgtggttgggcagaaccatcagctcgcccacacagcgccagcagggcacagaggtgatgtagaggcgcgggtctgggatgggacttacgccccgaaagcggcccagcagatccagggcccgttccaggctctccagccccatggtgtgagacatgcaataaaacacgctattgattctcttcattaaaatctctatgtcatttattaggcacaaacttacatcgactttatgccccccgtaaaactccacagagtacgcgactgagggggtacggagaggcgggacccgggtaccctttctaccaggggcgagcagcgcggcagaggcctctctcgagttctctagcaggtgcaccagctccagggacagggcgctgcatgcacggtcattctgccgtctcaaacggggaaggaggatggcctccagctcggccagcaggccggcgttgcgcaccaccgcagccacgtccagactccgggggtccagccgggtgcacacgctcagctcaaccgccagggcgtacacctggctgtacgccgccgccagcagccccgacatcgccgccccaggggtctctagacctcgagtccggggagaacggtggccagacggcgcttgcgtctgcccccggagccctgccctcctccacccagcagcagcccggccgaggcctgcgacgcggtgctgaccggctcggccacgctgataaagttgtcctgggctgccccgggcccaccccacactccctccagaaagtcccgagcggcctccgccgtccactctatcccgctggaggcaatggtcgccagggtttctaggacgctgtccgccaggacggagaagcggcccaataagtactccgcgtcgtccctagtcagcgaggcgcatgcctcgcccatggcatccacaaggttgcacaccacatcaaacacacagtcttcctcctgtttttgtgatataatggcctccaggccagccctgatgttctcaatctcatatgtggtcgcggcttgggtccggcgcttcacggtcaaccctagggtgggggtggcaaagacaaacttcttccgcatggaagagcccccggcctgcttgcgcagcccagccccgggggcctgcagcaggttcctgtccacgccccggcccataaagtatcccaggttcccggcctggaatatctggttgttgccgttgacccccgtgtacttgttgatggtcactggcagcgtgacaaccggacgggccttgcagacctggctaagacagtctgtggccgcgcagaccaccgtggtcgcagtaagggaggaggtggcctccgcgtaggccgctgccgactccaccgcccgcgtgcccagtacgtgggggtagtcacgggcgggcaccgactgcgtcctcggcaccagtccctgaatcaggctgatgtagaactgggtctggccgcacgccttcaggatggcgttgttgagcctctgcttggcgtaagtgaccaggttgccaggcaccacatctatgacgttgctctcttcgtgggcccgggagcccccgtccacaaagagggccaggtcagagtactcctccgcgctggccccgctggggacagggaccgagcgccgcctggaaaagttgtgccacaggtacaggcttgagagcttagtgtccgggaatagggtcttgtggtaggtgttgaggaatttcatgtagggcccgttgatgatgtagttctccctcctggtagtggacttgatgaagctgttctggagggcggcattctcccccgtgaagaccaccctgttcttgatcttgatgttcctggggcacagcatcagcaccttggacatgcgcacaggcagccgccggccgtacacccggccctgcagggccgcgtccaggtctggcaggtcgcaggtgggctccccatgcaccaccttggcctccttggccgtgaggacccccttgtcgatggccaggctcctaaagttggtgcacagcgtctggtagtgaccctttagccactctggggggctctggccaagcccggggttgtcattctcatagcacatacagatgggcagggagatgtcctgcaggatggtcagcagtgagcggtaaaacagctgggtgaagatggggcaggcgggctgcgcaaaggggttgcacgagtactgcatcacgtggtagcagctcttgaccaggtccttgtaggtgatgttgttcttggccatgctgttcataaactggaccacttcggcgtccaccgccgcatccacgtccttgaacatcttgacaaagtcacgcgggccatggggctccttctctagctttccttcagcgtctatgcccagccgagacagccgctccagcaggttctggttcagctgccagtaggtgtagcggggctcgtcgtccggccgctgcccgtcgtcctccttatcgatgaagttgagaaagttgcccaaaaagtccgtctcgttgtaggagcccgaggcccccgagatcacataggggtccctccgctgcgtggacatgacgggggggaagcggtccctcagcctaaagaagagcgtgttcaggcacacggccggggcccggccctcgcagagcgagcacatgggactggcggccgcccccgccacgtagctgcccgtctccggcaccggggtcagagagctcttctgtccctggcaaaactgcaggtagtaggcatagcgggcaagaaggttgggcgagaaggaggccgcatagaccaggtgctccacagcgtagtttcccggaccgttggttccggtcacgtctggcccaccccagcccgagaagcagggtcggcggcaggggtcccaggtcccctcctgcagggtccccaggccgtgggtcatgtagaaactgttaaagagactctccttgccctgaccggttgacttcgagacccccgagacgtagaggacggaattggtggcaaagatctgcgtggacacgtggggggccaggctggcattatatcggtgtaacgcagccacacgggcctctggaccctcacagtcggcaaacaggggccacgagtcgtagttgaggctggccggggtctcgtgcgaggcctccagcatggcgggtgcgtagctcaccgccagctcgcatgccgcgctgtccacaatcattaaggctcccgagtccgggtgactgatggttgaggctgggaactccttgaggggggccaccttggccaccttggcctggtcctgcaggctctgcttctccagcagctccaccagcttgcccacccgtcggacgcgcagcgcctgcgccagcccggtgtacagcgcctcgtgcatgcagcggctgaggtccgagttgtaaaactggcggagctggggcacgccctctgggaacacctccttgtcgtagagcgggaccctaacgctcgcagactgccccaccgctacctcctgttttaacgatggaatggccaccaggtttccgctgtagagtcgctccttgaaggcctcggttattgccaccgcccccaggtaggcagagggatctagcccttcggggaagaagtcccccggcttggagctttccctcggtagggcgctgtaggcgtcgtacccaaacacctccctggtctcgccacagagggcctcgagacccggcccctcaaagatggggggaaccatatgggcattgtggaacacgtagatgtccctgtgataggaggtagcgcgtaggagcccgcagttggggtcgggcctcctgtgcagagccttgacattgatgctgaagcccggctccacggtgatgccgcaaaggagcggcaccgtcaggcacctgtggcccgcgtagccggtccccagtgtggccacctccctaagagggtaggtggccagggggtaaaagtagatgtagccgcacggacccggctggctctggctgcccagattatcctcgctagtctgtgcaccctgcatgatgcccaaggtatcgccccggcctcccagtcccacattaaatgttacactttactcatcacgcaacacccactgtttattcatttacaaagatttcaggaagtcagtcaggctggccagggcccacgtcacggggaactgacgtctcagcgatcttggcatgccgcccagcctcgcaaaccagagtctgcgatagagggccaggtagtgggcgattgcccccagcacgaaggcggcgctcttgtggtcatccaggtagtttcgcaccgcaaacaccactgtgtagcacagcaccaccctgagccgcgaccagtagtcgtagtggtcgttgtacactgcgcgcaggacgctgatgatgagccgtacgtgcgtgtctttgcccccgatgtcggctgtcctgcaggccagctccgcgtacagcttcctatccttcctcagggaggccttgatgagccggcagaggaccagggctggcaaaggcaggtctttctcatcccgggtgaacaccgcgtacatggccctgaacatgaggtagctggactcagccaccttgtcgtccggcggcgagggcgcgacccacgcctcgaccggggtcctcacaaacacagaatctgtagacttggctggcctcatggtctcgtcaggccagctcacgggcttcaggcttatatgataaaatgggcgtggcagaatagtataagacgcgaggcctgggtgaggagagtccagagcaatggccaggttcatcgctcagctcctcctgttggcctcctgtgtggccgccggccaggctgtcaccgctttcttgggtgagcgagtcaccctgacctcctactggaggagggtgagcctcggtccagagattgaggtcagctggtttaaactgggcccaggagaggagcaggtgcttattgggcgcatgcaccacgatgtcatctttatagagtggcctttcaggggcttctttgatatccacagaagtgccaacaccttctttttagtagtcaccgctgccaacatctcccatgacggcaactacctgtgccgcatgaaactgggcgagaccgaggtcaccaagcaggaacacctgagcgtggtgaagcctctaacgctgtctgtccactccgaaaggtctcagttcccagacttctctgtccttactgtgacatgcaccgtgaatgcatttccccatccccacgtccagtggctcatgcccgagggcgtggagcccgcaccaactgcggcaaatggcggtgttatgaaggaaaaggatgggagcctctctgttgctgttgacctgtcacttcccaagccctggcacctgccagtgacctgcgttgggaaaaatgacaaggaggaagcccacggggtttatgtttctggatacttgtcgcaataaacgcacttgcctatttcaccttgttttagtgtggcattgggggggtggcattgcgggtggatagcctcgcgactcgtgggaaaatgggcggaagggcaccgtgggaaaatagttccaggtgacagcagcagtgtgtgaagattgtcacagctgctggtttggagaaaacgggggtgggcggtgatcagggagaacaattccccggggacacctgcacgagacccctgggctctcaggaactccgcccaggtcttgccaattggggtgatcctgtagcgccgcggtttcagcatcacaggttattttgcctgaagcttgctggggcgtaaatccctctcgccttgtttctcagagagcatttcaggccggttttgcagtcgctgctgcagctatggggtccctagaaatggtgccaatgggcgcgggtccccctagccccggcggggatccggatgggtacgatggcggaaacaactcccaatatccatctgcttctggctcttctgggaacacccccaccccaccgaacgatgaggaacgtgaatctaatgaagagcccccaccgccttatgaggacccatattggggcaatggcgaccgtcactcggactatcaaccactaggaacccaagatcaaagtctgtacttgggattgcaacacgacgggaatgacgggctccctccccctccctactctccacgggatgactcatctcaacacatatacgaagaagcgggcagaggaaggtaagagtgccatctatctgtacttttatttattgcatcacaagtcacatcaataataagggcgccatctagcgggagatgttatccacaccatcccaattcacatctcagggacaacaggtcaaagttctttgttgacacccccagcgctggctccagggggtggaagcgttggatgcagtcctccgcatcggggcggacgcctcctcccaacgcgtttctgcggatcagtcgctggctggtgggcatcggagtcggtgggcggtcctccacggggacacgctccttcttggccttgttctttgaccttttggacattcttctgaaggaacggcggagagtagcgtagaatccagccagtggtctacccggtcgcatggtggcttcttagatgaggagcaggcataaaagtccaaacaggacacagagtaccaccaggagtagtcttagtctgctgacgtctgggtcctcggggcaggggtggctaggcctggtctccgtagaagagccgggcaggccgcaggcagaggactgctgctctagcaaagcacgctccaggacgtgtaccatctcgagagtgaggcacagctgttttcgtggacttttatacagtaaggacaaggaaagaaggccagaggaatgtggaaagatgagcgaggacaggtgtggaggttttgggctagctcttagtttctgggtgtgagagagggattaaagtgcttatgcgcaaagaatgtgtcaacaacaggtgttcctgcctctgctggcatgagttaggtgtggcttgggctgaatccaaatgtgtattggcacaagatggaaagcaaagttgctggagttactgggtgggagacagggatgtatgtggtcccccgctggtatgccagtaccctgtggaagtaaggggcctcatctgcctggtagttgtgttgtgcagaggtctgatgtgtgtaggaggggtgggttcaacgcaggggcgttggtggcggagtctggcaacgcccgggtccttgctacctgtgtggtgtgttaagggctgggtaaaggtgtctgccaattctcgcatgtcctcctttccccttgttttgaaatagaatatgaatgtggcttttcagcctagacagacagtgtggctaagggagtgtgtgccagttaaggtgattagctaaggcattcccagtaaatggagggagagtcagtcaggcaagcctatgacatggtaatgcctagaagtaaagaaaggttagtcatagtagcttagctgaactgggccgtgggggtcgtcatcatctccaccggaaccagaagaacccaaaagcagcgtaggaaggtgtggatcaccgccgccatggccggaatcatgactatgaccgccgcctccgtctgtcatcaaaggcgggccctggtcacctcctttgttttcaacctcttccgtcaattgtggagggcctccatcatttccagcagagtcgctagggctatgaggcagcgggtcatgtgggccattgtcatcagtgttgtcagggtcctgtgggccattgtcatcagtgttgtcagggtcctgaggcagcgggtcatgtgggccattgtcatcagtgttgtcagggtcctgtgggccattgtcatcagtgttgtcagggtcctgtgggccattgtcaggaccacctccaggtgcgcctaggttttgagagcagagtgggggtccgtcgccggctccactcacgagcaggtggtgtctgccctcgttggagttagagtcagattcatggccagaatcatcggtagcttgttgagggtgcgggagggagtcatcgtggtggtgttcatcactgtgtcgttgtccatggtaatacatccagattaaaatcgccagaaacaggaggagccaaaggagatcaaccaatagagtccaccagttttgttgtagatagagagcaataatgagcaggatgaggtctaggaagaaggctaggaagaaggccaaaagctgccagatggtggcaccaagtcgccagagcatctccaataagtagatccagatacctaagactgcgttgaaaaaagagtgttagggttggaaaagtgggggtgtggtaaataattcctagggaatgttagatcttaccaagtaagcacccgaagatgaacagcacaattccaaggaacaatgcctgtccgtgcaaattccagagagcgatgagcaggagggtgactggggaaagaggagaaagtgcgttagagaaggaagagtaagggaaagggggtgtggggcaaagggtgtaatacttactcatcagtaggagtatacaaagggctccaagtggacagagaaggtctcttctgaagataaagatgatcaaaattataattataagcatgagagcaaaggaatagaggacaaggagggctcctccagtccagtcactcataacgatgtacagccaaaacagtagcgccaagaggaggagaaggagagcaaggcctagggaagaggagagggggggtcctcgagggggccgtcgcgggcccggtgggcccctctcaaggtcgtgttccatcctcagggcagtgtgtcaggagcaaggcagttgaggaaagaagggggcagagcagtgtgagaggcttatgtagggcggctacgtcagagtaacgcgtgtttcttgggatgtaggcccggggggatttgcggggtctgccggaggcagtacgggtacagatttcccgaaagcggcggtgtgtgtgtgcatgtaagcgtagaaaggggaagtagaaagcgtgtgtttgtgttagaaaagcgggtccccggggggcaagctgtgggaatgcggtggccaagtgcaacaggaaatggaaaggcagtgcggcaatcagaagggggagtgcgtagtgttgtgggaagcggcagtgtaatctgcacaaagaggcgcggggcgcgcaacgttgggaggtcgttggcggcaggcgggaggccgtgctttaggggggttcaggtgaggcaaggctgtggggtaaccgtaggggaggcgggtgaggcggctaagagggctaagggtcggcgggtgacgaagcagcagacggcggatatgggaatttcagaatgaggtggcggattcaggcgaaaagggtgtgggctgtgcgagtgtcatgaggcaggcgcggaaagtcgctgcggcttgctggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccgtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcgggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcgggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggggtgttggcgggggcatgggggggtcggatttcgcccttattgccctgttt

SEQ ID NO: 29 - DNA, 25 bp, Artificial Sequence
  reverse pol qPCR primer
agtccttcttggctagtctgttgac

SEQ ID NO: 30 - DNA, 17 bp, Artificial Sequence
  forward pol qPCR primer
ctttggcgcggatcctc

SEQ ID NO: 31 - DNA, 22 bp, Artificial Sequence
  EBV pol pPCR probe
catcaagaagctgctggcggcc

SEQ ID NO: 32 - DNA, 45 bp, Epstein-Barr-Virus (EBV)
gaaaatccatatcacgcgcggagaggcataaaagaacacgtaatc

SEQ ID NO: 33 - protein, 15 aa, Epstein-Barr-Virus (EBV)
ENPYHARRGIKEHVI

SEQ ID NO: 34 - DNA, 333 bp, Artificial Sequence
  sequence encoding gC-His-5H11 fusion protein
atggccccggggcgggtgggccttgccgtggtcctgtggagcctgttgtggctcggggcgggggtgtccgggggccaccaccaccaccaccacattcccgttctagaagaaaatccatatcacgcgcggagaggcataaaagaacacgtaatcgttctagaacaccacggcagtcaccagcccccacccagggaccccaccgagcggcaggtgatcgaggcgatcgagtgggtggggattggaatcggggttctcgcggcgggggtcctggtcgtaacggcaatcgtgtacgtcgtccgcacatcacagtcgcggcagcgtcatcggcggtaa

SEQ ID NO: 35 - protein, 110 aa, Artificial Sequence
  gC-His-5H11 fusion protein
MAPGRVGLAVVLWSLLWLGAGVSGGHHHHHHIPVLEENPYHARRGIKEHVIVLEHHGSHQPPPRDPTERQVIEAIEWVGIGIGVLAAGVLVVTAIVYVVRTSQSRQRHRR

SEQ ID NO: 36 - DNA, 4923 bp, Artificial Sequence
  Expression plasmid B557 (SPgC-His-TMD/CT-gC) (without the 5H11 epitope) sequence
ttcgagctcgcccgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacccccttggcttcgttagaacgcggctacaattaatacataaccttatgtatcatacacatacgatttaggtgacactatagaataacatccactttgcctttctctccacaggtgtccactcccaggtccaactgcacctcggttctatcgattgaattcatggccccggggcgggtgggccttgccgtggtcctgtggagcctgttgtggctcggggcgggggtgtccgggggccaccaccaccaccaccacattcccgttctagaacaccacggcagtcaccagcccccacccagggaccccaccgagcggcaggtgatcgaggcgatcgagtgggtggggattggaatcggggttctcgcggcgggggtcctggtcgtaacggcaatcgtgtacgtcgtccgcacatcacagtcgcggcagcgtcatcggcggtaagcttgatgatctgagcttggccgccatggcccaacttgtttattgcagcttataatggttacaaataaagcaatagcatcacaaatttcacaaataaagcatttttttcactgcattctagttgtggtttgtccaaactcatcaatgtatcttatcatgtctggatcgggaattaattcggcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctgttaacagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgacatgattacgaattaa

SEQ ID NO: 37 - DNA, 4977 bp, Artificial Sequence
  Expression plasmid B599 (B557-5H11) (including 5H11 epitope) sequence
ttcgagctcgcccgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacccccttggcttcgttagaacgcggctacaattaatacataaccttatgtatcatacacatacgatttaggtgacactatagaataacatccactttgcctttctctccacaggtgtccactcccaggtccaactgcacctcggttctatcgattgaattcatggccccggggcgggtgggccttgccgtggtcctgtggagcctgttgtggctcggggcgggggtgtccgggggccaccaccaccaccaccacattcccgttctagaagaaaatccatatcacgcgcggagaggcataaaagaacacgtaatcgttctagaacaccacggcagtcaccagcccccacccagggaccccaccgagcggcaggtgatcgaggcgatcgagtgggtggggattggaatcggggttctcgcggcgggggtcctggtcgtaacggcaatcgtgtacgtcgtccgcacatcacagtcgcggcagcgtcatcggcggtaagcttgatgatctgagcttggccgccatggcccaacttgtttattgcagcttataatggttacaaataaagcaatagcatcacaaatttcacaaataaagcatttttttcactgcattctagttgtggtttgtccaaactcatcaatgtatcttatcatgtctggatcgggaattaattcggcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctgttaacagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgacatgattacgaattaa

SEQ ID NO: 38 - DNA, 176048 bp, Epstein-Barr-Virus (EBV)
agaattcgtcttgctctattcaccctaacttttcttcttgcccgttctctttcttagtatgaatccagtatgcctgcctgtaattgttgcgccctacctgttttggctggcggctattgccgcctcgtgtttcacggcctcagttagtaccgttgtcagcgccaccggcttggccctctcacttctactcttggcagcagtggccaactcatctgccgctgcacaaaggaaactgctgacaccggttacagttcttactgcggttgtcacttgtgagtacacacgcaccatttacaatgcataatgttcgtgagattgatctgtctctaacagttcacttcctctgcttttctcctcagtctttgcaatttgcctaacatggaggattgaagacccaccttttaattctattctgtttgcattgctggccgcagctggcggactacaaggcatttacggttagtgtgcctctgttctggaatgcaggtttgacttcatatgtatggcttggcatgacgtcaactttacttttatttcagttctggtgatgcttgtgctcctgatactagcatacagaaggagatggcgccgtttgactgtttgtggcggcatgatgtttttggcatgtctagttgtcctcatcgtcgacgctgttttgcagctgagtcccctccttggagctgtaactgtggtttccatgacgctgctgctactggctttcgtcctctggctctcttcgccagggggcctaggtactcttggtgcagcccttttaacattggcagcaggtaagccacacgtgtgacattgcttgcctttttgccacatgttttctggacacaggactaaccatgccatctctgattatagctctggcactgctagcgtcactgattttgggcacacttaacttgactacaatgttccttctcatgctcctatggacacttggtaagttttcccttcctttaactcattacttgttcttttgtaatcgcagctctaacttggcatctcttttacagtggttctcctgatttgctcttcgtgctcttcatgtccactgagcaaggttcttctggcacgactgttcctatatgctctagcactcttgttgctagcctccgcgctaaccgccggtggcagtattttgcaaacaaacttcaagagtttaagtagcactgaatttatacctcgtgagtatctatttgttactcctgtttagttgaagaaaacaagctattggattgtaacacacattttacgctttgttccttagatttgttctgcatgttattactgattgtcgctggcatactctttattcttgctatcctgaccgaatggggaagtggaaatagaacatacggtcccgtttttatgtccctcggcggcctgctcaccatggtagccggcgctgtgtggctgacggtgatgactaacacgcttttgtctgcctggattcttacagcaggattcctgattttcctcattggtaagtgtgacaccaacaggtgttgccttgttatgtcactgttctgacacatgacttacatgggtttggcttttgtaggctttgccctctttggggtcattagacgctgccgttactgctgctactactgccttacactggaaagtgaggagcgcccaccgaccccatatcgcaacactgtataaaggtaagtattattaaattttagagacactatcacgtgtaacttgacgtgcaaggatggaggagaggggcagggaaacgcaaatgccggttgcccggtatgggggcccgtttattatggtaaggctcttcgggcaagatggagaggcaaacatacaggagcaaaggctatatgagctactctctgacccacgctctgcgctcggcctagacccggggcccctgattgctgagaacctgctgctagtggcgctgcgtggcaccaacaacgatcccaggcctcagcgtcaggagagggccagagaactggccctcgttggcattctactaggaaacggcgagcagggtgaacacttgggcacggagagtgccctggaggcctcaggcaacaactatgtgtatgcctacggaccagactggatggcaaggccttccacatggtccgcggaaatccagcaattcctgcgactcctgggcgccacgtacgtgcttcgcgtggagatgggcaggcagtttggcttcgaggtgcatagaagccggccctccttccgtcagttccaggccatcaatcaccttgtcctgtttgacaacgcccttcgcaagtacgattccggccaggtggcggcgggcttccagagggcccttctggtggccgggccagagaccgctgacacgaggccggacctccgcaagctgaatgagtgggtgtttggtggcagggctgctggtggcagacagctggccgacgagctaaagatcgtgtccgcgctgcgagacacttactcgggccacttggtccttcagcccacggagacccttgacacatggaaggtgttgagcagggacacacgaaccgctcatagtttggagcacggattcattcatgccgcggggaccatccaggccaactgcccacagctgtttatgagacgccagcaccccggcctctttcccttcgttaatgcaatagcatcatcgctgggctggtactaccagaccgccaccggccccggagcagatgccagggcggcggcccggcgccaacaggcctttcagaccagggcggcggctgaatgccatgccaaaagcggggtgccggtcgtggccggcttctacaggaccatcaacgccacgctcaagggaggagagggcctacagcccactatgtttaacggggagctgggggccatcaagcaccaggcacttgacactgtgaggtatgactacggccactatctcataatgttggggccattccagccatggagcggactgacggcccctccgtgcccctacgccgaaagttcatgggcacaggcggccgtgcagacggccctcgagctgttctcggccctgtacccggccccgtgcatctcgggctacgcgcgccccccgggccccagtgctgtgatcgagcatctggggtccctagtcccaaaggggggtctgctgttgtttctgtctcacctaccggatgatgttaaggacgggctcggagaaatggggccggccagggccacgggacctggaatgcagcagtttgtcagcagctacttcctcaaccccgcctgttccaacgtcttcattacagtgaggcagcgaggggagaagatcaacggccgtaccgtcctccaagcgctcggacgcgcatgcgatatggcaggctgccagcactatgtgctgggctccacggttcccctcggtggactcaactttgtcaacgacctggcgtccccggtttccaccgccgagatgatggatgatttctctcccttcttcaccgtggagtttcccccgattcaagaggagggcgcaagttctccggtacccttagatgtggacgagagcatggacatctctccgtcttacgagttgccctggctctcgctggagtcatgcctcacaagcatcctgtcacaccccaccgtgggaagcaaggagcacttggtcaggcacacggacagggtcagcggaggacgcgtggcacagcagcccggggtaggtcccctggacctgccgctggcggactacgccttcgttgcccacagtcaggtctggaccaggcccggtggggctcctcccttgccctatcgtacctgggatcgaatgacagagaagctgcttgtctccgcaaaacccggcagagagaacgttaaggtttcaggtaccgtgattacattgggagaacaggggtacaaagtgtcgttggatctgagggagggaaccaggctggcaatggctgaggcgctgctgaacgcagcatgtgccccaatcttggatccggaagacgtcttgctcaccctgcatctacacctggatccgcgccgggcagacaactcggccgtgatggaggctatgacggcggcgagtgactacgcgcgtggcctgggcgtgaagctgacctttggctcggcctcctgccccgagaccggctcgtccgcctccagcttcatgaccgtggtggcctctgtctccgccccaggggaattctcgggtcctctgatcacgccagtgcttcagaagacgggcagtctcctgattgcggtgcgttgcggggatggcaagatccagggagggtcgctgtttgagcagctctttagcgacgtggccacgaccccacgggcgcccgaggcgttgtctctgaagaatctcttccgggcagtccagcagctggtcaagagcggcatcgtgctgtcagggcatgacatcagcgacgggggcctggtgacctgcctggtggagatggccctggccgggcagcggggagtgaccatcactatgccggtggcctccgactacctcccggagatgtttgcagagcaccccggcctggtgtttgaggtggaggagcgcagcgtgggtgaggtgctgcagaccctgcgctccatgaacatgtacccggcagtcctcggtcgagtgggcgagcaaggtccagatcaaatgtttgaggtgcagcacggcccagagacggtgttgcgccagtcgctgcgcctgctactgggaacctggtcctcctttgccagcgagcagtacgagtgcctgcgaccagatcggattaaccggtccatgcacgtgtccgactacggctataacgaagcactggcagtctccccgttgacaggaaagaatctcagcccacgccggctggtgacagagcctgacccacgatgtcaggtggccgtgctctgcgccccgggcaccaggggccatgaaagcctcctggcggccttcacgaatgccggatgcctgtgccgacgggtgttctttcgcgaggttagggacaacacgttcctcgacaagtacgtgggtctggccatcggaggagttcatggggccagggactctgccctggcaggccgtgccaccgtggcgctgattaatcgttcccccgccctgcgtgacgctattctaaagttcctcaacaggccagatacgttctcggtggccttgggggagctgggggtgcaagttttggctggcctgggggccgtggggtcaacagataatccacccgcccctggcgtggaagttaatgtccagagatcacctctgattctggcccccaacgcctctggcatgtttgagtcccgctggctgaacattagcatcccggcgaccaccagctctgtcatgctgcgtggcctccggggctgcgtcctgccttgttgggtgcaaggctcgtgcctgggcctgcaatttactaacctcgggatgccatatattttgcagaatgcccaccagatcgcctgccacttccacagcaatggcacggacgcctggcgctttgctatgaattatccaagaaaccccacggagcagggcaacattgcagggctctgttcacgcgatggtcgtcatctggctctcctgtgtgacccctcactttgtacagacttttggcaatgggagcacattccccccgcctttgggcaccccacggggtgctccccctggacacttatgtttcaagcagctcacctatggtcactcaggcacggtcgcccctccgagtgaccagtcaccttccagactatgcatacactgaatttagcctgatattgtcccccgagccccgggcccagccctcctcagaaaactctgcatggagaagctggacgtgaacctcccccccccagacctgtgtgctgtatttacaaacactacaataaaccctatgtgcaaatgtggtttgtatggctactttgtgttcctaaaaaatgcaacaatagaagtggaaaccctcagtcacgggacattaacctcaaccacaaaatggggttggagaaagtaaccacatatactggagatgattcatgggctgggggttcccggacaatacacccatctggagttcaacctaattacatggtagataaattaagagtccctcctcaccactcgaaactatggcagacattctataagataacgaggagagatgaggtgagggcagaggacattgggcaggtgtgggccacggggcagctggccatatcccccgcaccacagaagtgtaagcaaagtgaagggctcggaaggcaggcggggcctagcaatgtcacagctaaatgcccaccggggcacacactcaagcggggtctcggagctcccaggtcagaccacgaaaggtcagcctgcaaggtggatggcgtgttttctgaggttatccccgctacgtgcagtgctgggtgagagagaccctggaatgtgtcgaaatgaccaagcgtccccgcagcggggctcccaacacgggttcccagagagggtaaaagagggggccataaagcccagggtgtaaaacaccgatcgcgccaccagatggcacacgtgggggaaatgagggttagcataggcaacccccgcctacacaccaactatagcaaaccccgccccgtcacggtgacgtggtctgtcttgaggagatgtagacttgtagacactgcaaaacctcaggacctacgctgccctagaggttttgctagggaggagacgtgtgtggctgtagccacccgtcccgggtacaagtcccgggtggtgaggacggtgtctgtggttgtcttcccagactctgctttctgccgtcttcggtcaagtaccagctggtggtccgcatgttttgatccaaactttagttttaggatttatgcatccattatcccgcagttccacctaaacggggcttaacgttacatcccagaagatgcacgcttaaccccgcctacaaccgtgacgtagctgtttaccagcatgtatagagttacggttcgctacatcaaacaggacagccgttgccctagtggtttcggacacaccgccaacgcgctgtgcggtgctgccgtcccgaggtcaagtcccgggggaggagaagagcggcttcccgcctagagcatttgcaagtcaggattctctaatccctctgggagaagggtattcggcttgtccgctgtttttgtgcctagttttgcacccacaacatgtaagggcccgctacccctacaacacaaaacaatctcctctaaccaaccttttcccaatcaattctgtgacagagtttcctggacacccagtcttagttcagatagacacccagttatgcagtgccaccaattccaatcatttttaaacctcctggaattctatcatcaaacggcatgcaggaaaaggacaagcagcgaaaattcactccccccttgggaggtggcggcatatgcaaaggatagcactcccactctactactgggtatcatatgctgactgtatatgcatgaggatagcatatgctacccggatacagattaggatagcatatactacccagatatagattaggatagcatatgctacccagatatagattaggatagcctatgctacccagatataaattaggatagcatatactacccagatatagattaggatagcatatgctacccagatatagattaggatagcctatgctacccagatatagattaggatagcatatgctacccagatatagattaggatagcatatgctatccagatatttgggtagtatatgctacccagatataaattaggatagcatatactaccctaatctctattaggatagcatatgctacccggatacagattaggatagcatatactacccagatatagattaggatagcatatgctacccagatatagattaggatagcctatgctacccagatataaattaggatagcatatactacccagatatagattaggatagcatatgctacccagatatagattaggatagcctatgctacccagatatagattaggatagcatatgctatccagatatttgggtagtatatgctacccatgcaacattagcccaccgtgctctcagcgacctcgtgaatatgaggaccaacaaccctgtgcttggcgctcaggcgcaagtgtgtgtaacttgtcctccagatcgcagcaatcgcgcccctatcttggcccgcccacctacttatgcaggtattccccggggtgccattagtggttttgtgggcaagtggtttgaccgcagtggttagcgaggttacaatcagccaagttattacacccttagtttacagtccaaaaccgcagggcggcgtgtgggggctgacgcgtgcccccactccacaatttcaaaaaaaagagtggccacttgtctttgtttatgggccccattggcggggagccccgtttaattttcgggggtgttagagacaaccagtggagtccgctgctgtcggcgtccactctctttccccttgttacaaatagagtgtaacaacatggttcacctgtcttggtccctgcctgggacacatcttaataaccccagtatcatattgcactaggattatgtgttgcccttagcaataaattcgtgtgagatggacatccagtctttacggcttgtccccaccccatggatttctattgttaaagatattcagaatgtttcattcctacactagtatttattgcccaaggggtttgtgagggttatattggtgtcatagcacaatgccaccactgaaccccccgttcaaattttattctgggggcgtcacctgaaaccttgttttcgagcacctcacatacaccttactgttcacaactcagcagttattctattagctaaacgaaggagaatgaagaagcaggcgaagattcatgagagttcactgcccgctccttgatcttcagccactgcccttgtgactaaaatggttcactaccctcgtggaatcctgaccccatgtaaataaaaccgtgacagctcatggggtgggagatatcgctgttccttaggaccattttactaaccctaattcgatagcatatgcttcccgttgggtaacatgtgctattgaattagggttagtctggatagtatatgctactacccgggaagcatatgctacccgtttagggttaaaaagggggccttataaacactcttgctaacgccctcttgagggtccgcttatcggtagctacacaggcccctctgattgacgttggtgtagcctcccatagtcttcctgggcccctgggaggtacatgtcccccagcattggtgtaagagcttcagccaagagttacacataaaggcaatgttgtgttgcagtccacagactgcaaagtctgctccaggatgaaagccactcagtgttggcaaatgtgcacatccatttataaggatgtcaactacagtcagagaacccctttgtgtttggtcccccccccgtgtcacatgtggaacagggcccagttggcaagttgtaccaaccaactgaagggattacatgcactgccccgcgggaaatacgtcctacccaggaacccgaaacagtgtttcccagaagctgtaaaaatagaacgccctggaactgccccactgtgcaatgcagcttttagccatgccatgctctataaatcactcccctatctcaggtaggcctgcacaccttaggtatggagcgaaggttagtggtcactctgcagtgcctggtgctgctttacctggcacctgagtgtggaggtacagaccaatgtgacaattttccccaaatgttgagggacctaagagatgccttcagtcgtgttaaaacctttttccagacaaaggacgaggtagataaccttttgctcaaggagtctctgctagaggactttaagggctaccttggatgccaggccctgtcagaaatgatccaattctacctggaggaagtcatgccacaggctgaaaaccaggaccctgaagccaaagaccatgtaaattctttgggtgaaaatctaaagaccctacggctccgcctgcgcaggtgccacaggttcctgccgtgtgagaacaagagtaaagctgtggaacagataaaaaatgcctttaacaagctgcaggaaaaaggaatttacaaagccatgagtgaatttgacatttttattaactacatagaagcatacatgacaattaaagccaggtgataattccataccctggaagcaggagatgggtgcatttcaccccaaccccccctttcgactgtcatttacaataaaatgaaaccttttattcttgattgcttcttgtgttcttgccgcccaggtaccttcctgtgttctccccacgggaaaaagaatagcttctgcagaaggccattgacgcaagttttgcccgtggggattacccgacccagccacttacagcacattttgttctaggtccatcttaggagcccgggccagcattctatcagcttaacgggaagagaagtggggagggcactcgcccactaaccttaacacctgcagcctacaaaagtacactagctgtttgctctattcgccactagagaccgccaaaatgcgaaactacaggcccgggcccaggccttgcagggcagacggttaggctgacaagtggacaagtgtggcaggtgggcgggaaggggcacaagaatgccggcgaaactggaccacggtccaccccgccctcaagcgtccgggagccgggcggctcggccaaggagggcggccttgcgaacaatcattagtagctaccaacaagggcccccagatgcccccaccagtcaccccgtccgtgtccactcacatattccactcttatttttaaattcatgtgtcccaattagaaacccaagcgcagaaattagttgagaggctagtgttttaaacatgcactctaggccagccagagataatttcacaagactatcaagttggtgtaaacacgccgtgggaaaaaatttatggttcagtgcgtcgagtgctatctttggaacagtagaaaattgaaccttgttggcgggagaaggcataacgccttatctgggaggagcgacggattatagccaataagagagctcaagacgcagggctcgcaaagtatagtggccccgtgggaccttagaggtggagcaacgtctaaagtggtaataacaccaggcggggctgggcaaaggggtcctacgggcgggattaattacgccttgcttacgcaagctcagttaattcgcccacgacttgaaaaatgtagcccttaaccaattggcggcccctaagggggggactaaggtcccactacaaaaactctgtgttcttctgcaaattttagatcagatggcatagagacaaggacaccgaagacccccagagccctcatcgcagggttcttaccatgtggccatgtaggcccacttaacactacaagacctacgcctccccattcatcatgtaacccgcaaatcatctaaaccgtaagtctaagggcctcctgaggttttctcaggaggccctaatgtataattaatcatgcatttgatttaaaaaaagtaggttatactcattttaggccagtctttatttgcagattaataatttatgtgattctccttccctctaggactgaagaaacagcctcctgcacgtgagcatgtatctgaaataattattatgtcataagtgtaatgatgagaaagtcataaacccacttccctttacatgaatctgggcactgaattttggggtacctctaaagactaacgtgttcgatttcggggtcacttccccttttataagtgtgtgaacagtgatttcagtaaaacctaagagatatttggtgtcacttccgcattttaagtttcagaaaattttaaaattaaaattgaaatttctctcaaaataattccaatgaaaacttcaaagaatcttatgtatataattcttttgccccaaactgggcttcagatgccttctattgcactctcacaaaaacattctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccagcggcccttctctctgtccccctgctcctctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagttccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacgttggacaggccctctgtccacccgggccatccccgcccccctgtgtccaccccagtcccgtccaggggggactttatgtgaccattgggcctggctccccatagactcccatgtaagcctgcctcgagtaggtgcctccagagccccttttgcccccctggcggcccagcccgacccccgggcgcccccaaacgttgtccagatgtccaggggtccccgagggcgaggcccagccccctccctcccaagctgctttgattcctgggatatttttgggaatggtgttaactttctccccttgtatttgctattcaatcaacctgattccccctgctcatacctccacttacaaccaagccactacggccacgtccccggcctcccgctcgggtaagtgctttttcatttttatccccagcccctcctctataagttctaggcaaacctccaatcaccagccaccttccaatgtagtctcttagagagtggctgctacgcatgagagccagctttgagccacccacagtaaccacccagcgccaatctgtctacatagaagaagaggaggatgaagactaagtcacaggcttagccaggtgatttgtgaatttcagtttatttactttcttccaatcaagctttcccagcctccgcttgttaggtcctagttatgggttttccatgggggacttagtatccgttctattagattaacgtgcaagacgctaaacttaaccaagggcagccaagggacacgtgttatcccaggctgcccaccctgaggatttccccccaaaatcctcctaccctctctttatgccatgtgtgttgttggcgtgtgttagtgctatgtaatgcggtgccgccaggtggcagcctgtttatagatgtgcagtaccccttaatgttaggtctgctttagggctgccaggtggcgcaatctaggattaatccacctgtatccctttccctccacccgcagtaacccagcactggcgtgtgacgtggtgtaaagttttgcctgaacctgtggttgggcaggtacatgccaccaaccttctaagcacccgcgcttgtgttttgctttatctgccgccatcatgcctacattctatcttgcgttacatgggggacaaacatatcatctaattgttgacacggatagtcgtggaaacccgtcactctcagtaattccctcgaatccctaccaggaacaactgtcagacactccattaattccactaacaatctttgttggggaaaacacgggggtgcccccaccacccccaccacccccaccacccccaccacccccaccacctccaccaccttcaccaccttcaccaccttcaccacctccaccacctccaccacctccaccacctccaccacctccaccacctcagcgcagggatgcctggacacaagagccatcacctcttgatagggatccgctaggatatgatgtcgggcatggacctctagcatctgctatgcgaatgctttggatggctaattatattgtaagacaatcacggggtgaccggggccttatgttgccacaaggcccacaaacagccccccaggccgtgttggtacagccacatgtcccccctctacgcccgacagcacccaccattttgtcacctctgtcacgaccgaggcttacccctccacaaccactcacgatgccaccaaggcctactcctcctacccctctgccacctgcaacactacttacggtgccaccaaggcctacccgtcctaccactctgccacccacaccactactcacggtactacaaaggcctaccgaacttcaacccacaccatcaccacaaagcatgcatctccctgtcttgcatgtgccagaccaatcaatgcaccctcttactcatcaaagcaccccaaatgatccagatagtccagaaccacggtccccaaatgtattttataacattccacctatgccattacccccctcacaattgccaccaccagcagcaccagcacagccacctccaggggtcatcaacgaccaacaattacatcatctaccctcggggccaccatggtggccacccatctgcgaccccccgcaaccctctaagactcaaggccagagccggggacagagcagggggaggggcaggggcaggggcaggggcaggggcaagggcaagtccagggacaagcaacgcaagcccggtggaccatggagaccagagccaaacacctccagtcctagcatgcctgaactaagtccagtcctcggtcttcatcagggacaaggggctggggactcaccaactcctggcccatccaatgccgcccccgtttgtagaaattcacacacagcaacccctaacgtttcaccaatacatgaaccggagtcccataatagcccagaggctcccattctcttccccgatgattggtatcctccatctatagaccccgcagacttagacgaaagttgggattacatttttgagacaacagaatctcctagctctgatgaagattatgtggggggacccagtaaaagacctcgcccctccacccagtaaaaaaccttgccctctccagcaaccaatgtatcccaaataaatgttacttcttttgctcttgaccattgacacgcctgtcattctatcaattaaacaagggaaaaaggtttagctattccaccaacacgaccccaaggaaggcttgccaaaattggggccttgctctcagcactttgccagcaacttatagcatggtaggcagctcaactcggcccgtcttactgcccagcctactctccactcccagtccatgttcgcactcctatgcatttccttccctcccacttttaccccagtcccaacccaaaaccacacacaacacatagaattgttagtttaaacagtttattgatacatggctgcttttagcctaattgtgtattgctctcgttgccaaaacctggtgtaagggccggcacccgcaacatggggaaaacataaccgccgccatcccatggggagggtagaggcggttgacatgtaggtgagtagtgtaagaagcatggcgaagtagacaggttacttttagagtgtagtgtacagggccgggcgcaacagtgccaccaacccggggtctgagcattccatgggcagcagggacactgcactaccgccaggtccaggggcagccggggttcctggcgctccgggggcagccgggcggtcgccggtgggtccactgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgcgggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgccgatccctcccccccagggcgtacccggcttgcctggttctggggctcctctgggggtcgctgcatccgccggtagggttagaatgggcgtggtccgcttgctctgctggcccggtacgcctggattgccggctgggggctggggtcccgggacgccccctccctgctcccacccggttccctcccccagggcgtgccccgcttgcctggtcctggagctcatccggggatgctgcatccgctagtccgacctgggtgggtgcggtccgctggccccaccctgggggtcgccgccgggtccgctggtccggtgcacctggaaggcagggggggggggggcgtaagggaggggcgtggtcctgggaccccgcgccgactggcagggggtccccgtggcacagggctaggggtccggggggcagccgcggcccagcgcaccccgttcacgggggaggaccgcggccgagccaccatgggcccggcgggggtggggggtgcgctcccaggccggaccctggtgccaggcagggaccccgcgccacccgcttcatggggggggaggccgccgcaaggacgccgggccggctgggaggtgtgcaccccccgagcgtctggacgacgctggcgagccgggccggctcgccttcttttatcctctttttggggtctctgtgtaatactttaaggtttgctcaggagtgggggcttcttattggttaattcaggtgtgtcattttagcccgttgggtttcattaaggtgtgtcaccaggtgggtggtacctggaggtcattctattgggataacgagaggaggaggggctagaggtccgcgagatttggggtaggcggagcctcaggagggtcccctccatagggttgaaccaggagggggaggattgggctccgccccgatatacctagtgggtggagcctagaggtaggtatccatagggttccatgatcctggaggtatcctaagctccgcccctatataccaggtgggtggagctaggtaggattcagctaggttcctactggggtacccccctaccctaccttaaggtgcgccacccttcctccttccgttttaatggtagaataacctataggttattaacctagtggtggaatagggtattgcagctgggtatatacctataggtatatagaacctagaggaagggaaccctatagtgtaatccctcccccccctacccccccctcccttacggttgcctgagcccatcccccaccccagcaccccggggtgacgtggccccccgcgtgccttcctgacttgtcacctttgcacatttggtcagctgaccgatgctcgccacttcctgggtcatgacctggcctgtgccttgtcccgtggacaatgtccctccagcgtggtggctgcctttgggatgcatcactttgagccactaagcccccgttgctcgccttgcctgcctcaccatgacacactaagcccctgctaatccatgagccccgcctttaggaagcaccacgtcccgggggcggaaggggacgttggggtgattttctatgtgggggtggaaatatgagcaagaataaggacggctccttattaacctgatcagccccggagttgcctgtttcatcactaaccccgggcctgaagaggttgacaagaagggtcaaggtttcgtctgtgtgttgaagggcaggggctgttgggtgcatctggaacggcttacctcgggtaactgtttgccattaaaaggttggggattaggtttagcccctttagctgccatttcgaaccggggtgtgcagatgcaggtctccgggtgggcaggcagtacgagatgtcacgttgtgttgtctttcctcccacccctgtcctggctgtggcaaatgcgaccctcatagagttgtgtttcaggtctgtgtcctgttttgcggtgggttatttcccccctcagtgttcgccagcttatttccccagtccccacgtactggggcctgtggacacctgagggagcggccgttggtgggcatgtgttggaattgctcccaccctcaattttcgcttgccttcttcccttgttaacctgatagcatagcctctaggtttccttgtaggtctgtttgggtttgttggttcacgtggtgctaacttgaattttttggttttctagttccctcttaattacatttgtgccagatcttgtagagcaagatggcctattcaacaagggagatactgttagccctgtgtatacgggacagtcgtgtgcatggaaatggtaccctgcatcctgtgttggagctagcagcaagagaaacacctctccgcctttcaccagaggacactgtagttctgcgttatcatgtgttgcttgaggagataattgaacgaaattcagagacatttacagaaacttggaacagatttataacacacaccgaacatttggacctggattttaactcagtatttttagagatatttcaccgtggagacccaagccttgggcgcgcgttggcctggatggcctggtgcatgcatgcctgtaggacattgtgttgtaaccagtctactccttactatgttgtggacctgtcagttcgtgggatgttagaagccagcgaaggcctggatggttggattcatcaacagggcggctggtctacattaattgaagacaacattcctggatccagaaggtttagctggactttgtttcttgctggactgactttgagtctgttagttatatgtagttatttatttatctccagaggaagacactaatctatacattttctcagcactttatatgaatcagggtcattgggcctgcagggaactgagccagtaggatattaggcaagggtgacacagtgcccatgcattataatttaaccaaacagtggtcgtgagttttaggccggccatgggggcttacaagaataacatgccaatgacccggcccccacttttaaattctgttgcagcagatagctgatacccaatgttatcttttgcggcagaaattgaaagtgctggccatatctacaattgggtgtcctaggtgggttatacgcctgtggtgttctaacgggaagtgtgtaagcacacacataatttgcaagcggtgcttcacgctcttcgttaaaataacacaaggacaagatactaaagaaataactgaggtgagtgtgggaagatgggactacgatgtgttatgttaacgggtgagagcctatactgcagcccagactcggggggaggaggaaatggtaagagttatactctacttatcttttttgacactacagttaactgttatgtaacaatgtttgcttattttcatgttcaataaacgctatgttaatgatgaagaacctgtgttgttctttggaagtgggcccgatggggtagtaggttttgggagggtgccgtgctagatatttcaactgccacagaccccattttgtcccacctgttaccacattctaggtcctgcatccagtgggccaggtgtctccccatggctctttctaggtggatcccacagtccaggcccccaaggctaccgtgctaattacctcctcatgtccacccccaccctgtgttactgtcgcctgattatcctggcttagcagcctccaagttttacaagacgtcccattgccctgcccttggtccaagtctcgccggttttcagcagcctgttgtagcctgcccccaagtttcgcaggtttcccccatgcttccacccgttaacccaatagcatgacagccaatccaacacgaggcaagtttcaagagttaaaagcaactactgtttattttccaaaatgagctgggtatagttgatgatctgtaggcgcagctcatccccacattccaggtccttgatggcctcgtagatggcatcttcgtcgacattgacagtcttctcatataccgtgtctctggggctgacctttatgcagaaggcgtcccctactaggtccacggccagctcgtaggtggggcctatgttttcacataacagtttcaagcaggtctctgggatgtgaagggaggtgccctggagcaggagatgcatgattaggcgcccttttccatttgtgctgaagatggggcagatggtgccacaaaagtgtccggtgaccaggtaagcgtagagaaggctgggttgggaaagtccagcctttactgcactgggagagctgctgagcagagacacatagaaggtcttgttgggtattatcttgtggacattgttgaagaaggagagctgggtggagctaaactcctgaggcacatgaacctgggacctattgatgcagatctcgcagtgagaccccagagtcaggctgtggccgaagggagacaggcgaaggcagcgcccgggggagagagtgcacagtgacagtgggagaaacacggcctctgagacatgtatgggggtgttcatctcacgcagaaaatctttgcccagctcaaagttggcagagattcccctgaagaagtcccgtagtgaaaaatgggatctgtctacaccatgtctggtgtgccgggaacatattgagcgggccacactgccaaccctttccattcttcccagctctgagcgagattttccacacctggacaccgacttcacgctatgtgccgaggcttttgaggccgtatagtttctgtggtgcggatgcattaggcggcgcaatgtgggatctgccggccgctgtcggcgtgcatccacggcctctggggtgaccggggccatcggttttacttttcacacgtagacctgggaagtttgataggactgtaccaggtcaaggccgtggatgcgcaggaccacgtccagttccttagtgacatccacgaggattgttttgcccactctggccacttgtgtggatttaaatatgtacacaagcgtaattaacgagtcacagaccccctgttccagattctgaccggctgcaagcgctgccttaaaggcctggaagctgggtgggtaaatctgaccaaacagcacgctcggattcgtgatgctgtggttgaaggcacacagggggtcgcagaacaggtgcttgtggaagtcttgcggggtgcacatctgcagccaggcccttagcctggggcatggcacatccagcagcgtgttttgggtcttgatgaggaacacgatcctgtctaggattttgatgttgttgccgaatgagtccagaattaggctcttgaagcggtcaagggtgtccttggcgtccgggtgggccccgaggctctcgcagagtgggcagatggtccgtgaggcattcttgtgccttagtccaaacatgggggccaggaggcaagggccctgcgaatggtcgccagcctccggtctggtgatggccagggccaactccgccagctcatcgccgctgtattccgcgtttaaaccgatagcatggtggcctggccccccgagcaggtccgtcccctgccacgtacctaatagtagtccacagtagtcggccttggttgtaatttcaggagagagtcctcccttttcggccctgagaaatggatgctgaactcggtttctggtaggcaggtggcagcacagggcggtgtactggcccctgccgacgtcccctgggacatcctgggaatctttgcaggttctgggtccagggagggtaagaaaagtgggggtggttctgggccacatggacttgaagcagaagttggccggggactggccagtgaggatggatttcagaaactccaatttgtagtagccgaggttggcatttctaatcatgtcagaagaggacacggggaggaagcaccggcaaatgtaaaagtgaagctggatgtcaatggccagaatcctggagggcatgaagagggaatccaaccccccggccatggggaagtattttatcaggatgtgtaaaaagtccatgcccgtgatgaggctagagatccaggctcgtggggcatttagacagtagtagcagagcagggcatagtcctcaaagaaggccacgggggcatctgagtgattgaccagggtgtcgagcagatcacaaactcggcaggtgctggctggagagagggactcgtaggtgtggacgagtggtgggtaggctatgccttcttccgcgttggctggaagataggagtgggccatcaaaaggccgactgcctcgaactggcttttcagattgtccacggtccagggcacaaactcctccatctttggagttctgcccgcggtctgtgccacctctgttacgccactcctcgtgagggggcagctggacagtctttttccggtcagggggtttggctcgtttgcgctcgtgactttgtgagccatgacacatctgggtggcaaggtgaggtcttctgggtttttaataccggggtcggcaccagtttctgggacaccgccacaaggacaaggtgggctagcaagttctcgagtctatgaagactccgggggcagttttttgagtttctcgcctatgatccaccccaatctcgcccccataattgcgccatctgcctacgcgaggctgaacctcctgaatcactgcatctttctcgaggcgtttaaagaagagaatagtggccagggcctcggtggggtccagcgtgaggtcttatttttgaaaagggatattataaaacaggtcattgctcggattgtggcagccgatagcaccctagatctagtgaatcatggcgagcccggaagagaggctcctagacgagctcaataacgtaattgtgtcatttctgtgtgactctgggtctctggaagtggagagatgctccggggcgcatgtgttctccaggggcagctcccaacccctctgcaccgtgaagctgcgccacggacagatttaccacctggagtttgtctacaagttcctggcctttaagctgaagaactgcaactacccctcctcgcctgtgtttgtgatatccaacaacggcctggccaccaccctgaggtgctttttgcacgagccgtcgggtctcagatcgggccagagcggcccttgcctgggtctctcaacggatgttgacctaccaaagaactccatcattatgctgggccaggatgacttcattaagttcaaaagccccctggtcttccctgctgagcttgatctcctgaaatctatggtggtctgccgggcctacatcacggaacaccggacgacgatgcagtttctggtgtttcaggccgccaacgcccagaaggcctcgcgggtcatggatatgattagtgatatgtctcagcaactgtctcggtctggtcaagtcgaggatacgggcgccagagtcacaggtggaggaggtcccaggcctagcgtcacgcactcggggtgtcttggggactcacacgttagggggcgcggtggttgggacttggataacttttcagaagctgagaccgaagacgaggcgagttacgctccttggagggacaaagactcgtggtcggaatccgaggcggcgccgtggaagaaggaactcgtgaggcaccccatccgcaggcaccggacacgcgagactcgccgtatgcgcgggagccattcacgggtggaacacgtgccccctgagacccgggagacggtggtggggggagcatggcgttattcttggcgcgccacaccttatctggcacgggtgctggcggtcacggccgtggccctgctcctgatgtttctgaggtggacctgacgttgccggcccttgaggagcgggagttctccaggctcctggatctggggctggcctgcctggatctgagctatgtggaaatgagggaatttgtggtttggggcaggcccccagcttctgaggcggctgtggcctctacgccaggctcgcttttccgaagccactcgtccgcctactggttgtcggaggtggagaggcccgggggccttgtccgctgggccaggtcacagaccagcccctcatccctgaccctcgcgccccatcttggcccgtccctcttgtccctttcagcgttcaccggtggtgggtgtggagccgtggccttttgcaacgccttttttcctagcttattttttggttgtgcggtctgttttccccgcgttttccgatagaatagctgcctggatctgcgcccggtcccctttctgcgaaaacacccgggccgtggccaggggttaccgaggcctcgtgaagaggttcttggcattcgtgtttgagcgtagtagctatgacccccccttgttgaggcaaaactctaggcctgtggagcgctgctttgccatcaagaattatgtcccgggcctggactcacaaagctgtgtgacggtcccgagcttctcccgctgggcccagtctcacgccagcgagctcgatccccgggagattcgcgacagagttacaccagcgactgcaccttcgttcgtggctgatcatgcctcggctctattggcctccctccagaagaaggcctccgacaccccctgtgggaatcccattcagtggatgtggtaccgcctgttggtaaactcgtgcctgaggagcgcccactgtcttttgcctatacctgccgtctctgagggggggagaaagacgggcgggggcgtaggggaggagctcgtgggggccggggggccctgcctgagccgggatgttttcgtggcgatcgtaagccgcaatgttctctcgtgtctgctgaacgtgcctgccgcgggtccctgggcctacaagtgtttcagatccctcgcctccagaccggtgtctggcccggattaccctcccttggccgtgttttgcatggactgcggttactgcttgaactttggaaagcagacaggtgtaggaggcaggctcaattcctttagacccactctccagttttatccccgtgaccagaaggagaagcatgtgctgacctgccatgccagcggccgtgtgtactgctccaactgcggctctgcggcggtgggctgccagaggctggctgagccaccgagcgcccgctcgggctggcagccccgaatccgggcggtgctgccgcacaacgcggcctatgagctcgaccgtggctcccgcctcttggatgccatcatcccctgcttgggacccgaccgcacatgcatgcggccggtggtcctgcggggggtgacggtcaggcagctcctgtatttaactttgcggacagaggccagagccgtttgctccatctgtcagcaacgccaagctccagaggacgcccgcgacgagcctcacctgttctcctcctgtttagaggtagaattgccacctggtgagcggtgtgcgggctgccgtctctatcagacgcgttatggcacgccggctgcccaagcccaccctccaggggaggctggaggcggattttccagacagtcccctgcttcctaaatttcaagagctgaaccagaataatctccccaatgatgtttttcgggaggctcaaaggagttacctggtatttctgacgtcccagttctgctacgaagagtacgtgcagaggacttttggggtgcctcggcgccaacgcgccatagacaagaggcagagagccagtgtggctggggctggtgctcatgcacaccttggcgggtcatccgccacccccgtccagcaggctcaggccgccgcatccgctgggaccggggccttggcatcatcagcgccgtccacggccgtagcccagtccgcgaccccctctgtttcttcatctattagcagcctccgggccgcgacttcgggggcgactgccgccgcctccgccgccgcagccgtcgataccgggtcaggtggcgggggacaaccccaagacaccgccccgcgcggggcacgtaagaaacagtagagggcacgaaacatggtgtatgcactttattaataaacaattacagatacaaaaacttgagtctctcgaggtctgcgatgaggcggtgggtggaacgctccagcttgcggcgaagctggctcacgaagcgagacaggactcggctagcctgactaagggtgaggctataacgcaggtcctgttccggagcggcggtggatagagaggagggggatccggaggggaccactaggtcgccggaggtcgaccctcctgtcaccacctccctgataatgtcttcaatagacagaaattgggtgaccactgagggagtgttccacagtaatgttgtctggtcgctagatggcgcgggtgaggccacgctttgcgaaaacgaaagtgcttcaaaaggcgcgggatagcgtgcgctaccggatggcgggtaatacatgctatccttacattttggcattttgggcagctgggaggcggcggatgggggtgcttctttttgcacggtgtatgtttggggacccgcatgccggtactgggataggcgcacctcgggccgcgcgccaggctccgagccggaatgcattgggggcaatgggattgcgggggattgttgctgtctgctcctgacagggagagacacgcgcggcggagatgcagccgacggcggggccgcggtgggctgcccccgaggacgggcgccggccgccagcgcccccgtggcctttggcacgggcctggcccccaccgctttaattgtgggggtgggcagggcagctgcatcttggggcctctgtgcttgcgttttttgggggcttggtgccaatgcaccaactggggtgtgcgcgggggcggccaagccggaccccagggcgggtgcctgggggatgggaaggccggacggcgcttctcccgggtcgaacgctggagtagcggaggctgctgcgccggcggccaccacgggcgcacggggtcgcagcccgacggccgtggggaggcgggtggcggagggccgaatctccgcggcttcttcccggcccccctgctgtttcttctcccgttgcatgatagaatggccatagggtgggtcctgagaggaggcttgtgtgtcctggggctggagcccaaaagtcgttaaagatgccgctgatggtgtgggagctatgcctcccgtcgactggccgggcttgtagggggctgagggtgaataactgggcttctgtgaaggcaccaaccctggaatctggatggtatgtttcttctgtgaccccgaggcagtcgatggtgtagagtgtggagacaatgtgtaaacgatgggctttgaggggggctgttgtggtgctggttggggaaggagctccagggaatctttgggccatggccttggggaccttcccggagaccggtctgggctctcggaagccctcgtttcggccccgaaatagggccttgccatcaatcgggggcctgggagagtgatgggggcggccaatcccggggtaactgtcacgtcccggggggaggaggtaggagacagccagtccctgggcctgcctggggccaccttctctaagagagggctctgtgggctgggagggccagaggcctcagattcagccgtagtgctccccttttccccctggtctgtctcccctcctcccaactgctggagccggtcggaggaggccggggtgttatctgctgactgaaacccgtccccgctgaccagtccgtgccccacccttggggggaaaccggagaacagctcctggacgttgcgtggattcgggggaagctggtatccaaccggcagtggaggatcttcgtgctcgtagaaggaggggttgagtacatcggtcggccatcgtgaggccccggccgcgttaaagtagaactgcacgtttggcagattgtgccgataggtgaaacacttccagatgatgttttttctgttggccaggatggccacggtggggggcctggcctccttaggtttggcggccctggcctcggtgagaagctcgcgtagccacacggcctggcgtgcaaagatggacatctccggctcgaaagactcggagtagccgtccaggtcctgcagaaaattcagcgagatggtctccaccagggaccggaagggctcggagtgcccgtcgcagtagaggaggggagcaacgaccctgacctgtcccagggtcttcaggttaaacagatattgagaggagacaaagagagttaggggccgaccgaggaaggccgccgccacggccgcctcaaaaacggagacggggatggtgtcaccggagcccctcttaggaccggtaatgggagtgccataaggcataagatttctcagggcccggccggtaacggtgccgtaggaagacggggtttcgcgggggacctcgagtccctccgccctgggaagctcttctccgcgtgtataggcctgcttcacaaagtcacgcaggtagtcctgaaacgcgaccgggccctccagcgggcgcaatgagtgccagagctgctgaagggcctcgggggcgaagcaccggcgtgcgaggagcagcatgcaggctcgggcgcgggccgtgctttggttgtggaccaggcccaagaactcggggtgcggccagagggcggcccgggtatccatctcctcccaggcgtcctggaagaagatgaagccggtgggtggaccggcgatgcggtggcgggtgaggcggcgcgcgtcttccccgtcgtcgctgccgcgggtggttgagggcatgccccccctcccggaggctggactcctgaccagcctgtaggtgaggaccgagtccgacaggaggtctcccaaacccccatctctcgctagagccgagaccaggccgagtcctgcgtagaacgatggggcgcccaggaaggcggcagcgtaggccggatgtgtgccgaccagcagcgccattatctcccgttgttccaatagaataacttcccggtctgtggccggggctggataagggggtgattcctagaggcgatgagactggcgtgcgctaaaagcgtcatggccacaatggggttgtctgccaggtcttccatcagggctttgggcgcagagacgtattcccgaagcagctccccggcgttggactccacgtcgggccaggtgtcccagtaggagtcggcggcggcggcgctgaggcgggcggaagctacactggccagggttcttctcctcctctcttggtcatcctgcgggggaccaatagcttgggggcgtccggctggggtcagggaaaaggcctctgggttctccagcacggtgggcatgacatattccagaaagttgtggtagacggggatgtagttgagcggctcctgggtgtctgcggagacgtaggccgggttaagggggtcgcagggagactctgtttccagccagagggtgccggcgtatttcgccggccctgccgccgccagaaattgtgcccgccgggtcggggctccattgccccatccagttggtggtgccgaaatcgtgatgaggaggggcaggttgttggtcaagggatgcttaacgaaaacggtaggctgggcggtctcgtaaaaagccaggaaactctgcttggccgaggcatagcgcagcagcttgtccttgaggagtgcatactgggagccagccgaggccccaagcgccaggcccctggcagcctccaccacgatcttgagctggcgcgggtcggtgtggcccctggcctgggtgaccaggtcctgcagcgttccctgcagctgggactcttcctgggcctcctggatgatggcctccagtcgggagaggcgccttttccagtctgcgaaggtctccttgccccccgcgacccgcttggggtccaacgtggccagagccaacctcagctcctccatgccatccatggaattctgggccatgccctcgacttccaggagccgtgttagctcatgaatttcaccgtcagccgcagcggctaggttcagccaggcacccacacccccagctaaggccagggctccttcggaaagaccccgcacggcctcgcagatgccccggatccacttggcggctgccagggatttccggtagggccacgagccgttcccggccgctgcccgggccagggcggcctcgaggggagcctggacaggggctttgggcggggaggggagcaggctccggagttcatcgtcgggggcttcgtcgcgtgacctggagaggacggcctccagagccgtgtgaaagccccgccgagtgcttgccgccatctcgtgggccttcgccatcagggtctggctctcccggacctgctcttccagcgcccggacctcggccgcctcggcctcggtcagcagctccgagaagaagtcccccgtggcctggaggagatcgtcccgctctcgccttgtcagcagctggggtttcttaggccagagtgccgagtccgaggccagcctgggcggggcggttgcctgggggatagttggaggaggaggcaggttagcctggcctgggtcattagtggcttcgggtagcgtccgatccacgtactcgctcacgatggccgtcagggcagcctcggctgatcgtcttttttccagaagcccggccagcccccgctcgtactccgcgtagggggcctccagatccgtgttgaccaccgctgatttcatgtccggggactgcagggcctggcgcgtctgcgcgagggccgaacggatggcatcggccgccgtcctggcgcgaaagagggccccggctgcttcctccgctcctcgccctcctcctccttctttggcggtagccgcgggggtggcgggccaagcgtccagtctggccagagggccggtctcgatctccgtgaaccagccgggttccgcagcctccattctctccgccgcaccaccatcgtccacgagcagggattgcagtctctccctcctcaccctcgttattcccaatagcatagcggcaaggatctgtgtgagggagtccaagatgtccgtgtttctggctactgccgccgctgctgccgcggctgagtccgtattgtctggcagcagggaggccagcagggtgttccagtcatcgggcgaagtgggagcgggctctgggcgtgcccccagcgccttcctaattctggcccaggcctcattcgcctctcgcgctcgccgctcccgcctctccttgtcttcctgttctcggagcttctccttttccttgcgcccggtctccataagctgccgcagcttcttctcatactgtcgcttgagctctttgttgggggcagtgtccagaaaggcctcgagctgttcctcggtggcgggcttaaagccttcggcctccaggcgccaggcctgcacctccttctgtctgagctgatcgttgttgttattcttcaatttctgcaggtaacttaggaagcgtttcttgagcttccctgggatgagcgtttgggagagctgattctgcagcccagagagtagtctcagggcatcctctggagcctgacctgtgaccgtcgcatcatagaccgccagtagacctgggagcagattcaccgccgcggccgtctcctttaaggtgctgtgagtagcaaaattctgcaaggccactaggcgcgctggctccagcgtcagccggttgcccatctcgaatgtgtgcagggcctctgagaccatggggtccaggatgcggtcaatgccatcctgcacctcagggtcaaggaccggcaagtcacgatagaggtggtctatgctctcctcgaaggaggcaatgtagttatcgatggtgtagaaggtgatggatttcaggatgttcatcaggtacttcttggagcgaacaatctgctgtatagtgtcacgtaggcggatgtacgtggggttctttgcggccccgactatcgaccctgcatttgcgatgtacttttctatgacggggatggtgagggccgcggtgtcggccagcggtggcgtggcttcggggttgtcgtggttggcgggtgtcgcagagggagaggcgggagagatgggggcgcctgggggccgaggccacaccggccaggcccaacattgcctcgatgtcgtccaggatggtgcggaggcgcttttcgttttctctggtggtctcgagctccttctgttttttcgcgactgtctcaaactctggaaggggggcaatgctggggtcgtcctcctcaactcgctccaggggccaggggataccgctcatatcactaagggcggtgcccaggtagaggagctcgcgatagtcccattcaatggacgtgtaccggatgtttaggagaggcagggaggcgatgatctggcatgtgtgccgcaggtgtgtcaggaggtcgtcaaaatccatcaccgttgggaggcttgggtcctcaaggtaggagagataatcggaggccgccgaggccaccttgtccctgatgtccgccgtacacctgcgcacgtgcagggccgcattcttggaccggacggccacgttgtggacaaaggggggcactgaggcggcgggaggggccccatactctatcgctgtcaacagcgccaaaaagcggacgtcctcctcatctaccccagcctgttgtctggccacggccgttcgggcggcctccgccagggataggaggcgcttccagctctcgtcgtccaggaccaaggggacgtccacgtgcgggcccctgtagatggaattatcctcgggttctcctcctccttctcccccctcctgatctccgcccgagagcaggtcggtcaggcgtctgcgggccgcctccaggtcaaattttccatcgtcgctctcggccagctggggaatttcagccagcatcttagcaccggcatctacacggaccgcgtccttcgtggccagggacggcaggcaggcctccagctttgcggccaggtgctcatggaactctcccgctcttcccttgttttctgatagcatgtttgcgaggttttggatgttaagttcggaagtgagcagttgctccaggtccagcgtggggacctgcagatgtcccgaccagtcctttaagaattccagcagatttagcacagcagatcggtccctactccttattagcccctgctcgaggaccactgtcacaagaagatagtctatcatgctcaaggcatctgcctctggcacttcccggttagaggccgggtcgtagacgatggcctgttcctggtaggtatgtccggctattctcgcaatgttgctctcgaggggcacaaagtccatctcaggagtctctatgtcaaaggtggtctgatagtattggctcctggcggtgtccagtgtgatgggggacgtgggggcactggatcccgattccaggctgttggagaacacttcatcttcgaacatgtcttcatcctctgtggtggggatatcggaggctaagtcgctctccgcttcttcagagtcggacatggataggaaaggttcctctaggtcagacaggtagcggacgaggccagcacccccagatgcatcttccccaaaggagggctgctgcccgaagggaggtgatggggatatctccgttccagccctgtcagcggccgggggatggtttttttctggttcgagtgtcgtggctgatggtgggatctgctgagcaggaggaggagccggggtagctgatggcaggggctgctgctgaggaggaagaggagaaggagcccgggcggctgatggcgggggctgctgctgaggaagaagtggagaaggagccggggcggctgatggcgtgggctgctgctgaggaagaagtggagaaggagccggggcggctgattgcgggggctgctgctgagttggaggaggagaaagagtcgtggtggtgggggctgctgctgcagtcggggaaggggatggggtggtcagagggatttttgggttcgagggagctgcctgtggcagagggatgggtatttgcaaagggaggcgaggagatggagtgactgaaggagcgatagttgagactggtgcggggtggggtgtcggggaggcgggtggtgattggtgagggatggggattactggagggggaaggcgagctgctgaaggggggcgatggggcggaacgtgggtgcgtggcagctgatcatcctctgtgtcagtggtggaggacagagggaggcggcggccggaggtgggcttcttgtgggggctatctttgcccaatccctttttcctcttgggagtctgaggcgctgcgccgcccgacgcccttggtggcgtggagggagcggggaccccgggggtgtgacctaggccggggagtggggatgaagaggggagggctggaggccggggccgcggaggccggggccgcggaggccggggccgcggaggccggggccgcggaggccggggccgcggaggccggggccgcagaggccggggccgcagaggccggggccgcagaggccggagacgacggcggggagttggtctttgcaggactatacctggcggcagggaatgagtcggatgtgaaagatcgagagggcagtggcctgaggttatacggtattattcgccgttcaaacggtagcatgacgggagggctgctatcagcaccgggcgtccccgccgcctccccatcactggacacaagctcgggccccaccaggtcaaagccgctgccgttggcctcataaaagtcatacacgccatagtgttccagcataaagatgcgggggtcctctgtctcaaaggcctcgggtagaaaatagagatgcacgcaagtgtactgggcccctggtgcccccacgtactgcaggatgtcgtgcgcataggtgctgactctgacatgggcgggggtgcccggggccgcatccttctggcagtgggggtcaaacaagtagaaggagccatctgtctcgatgatgatggcccccgcgtagatgtcgcagatgtagaggatgaactgggccaccccgttgtaactgccgtgcaggacctcggccagggactgaacaactgccgagtttgcgatctgggcagggaataggacgaggccaaagatctccgccgagcggtatatgtgcacgcgcccaccgcccctcaggaccacggagctgggcacgtccgtcaactgggccatctcgtgccccttgaggatgccgctctggcgcatgagggcatccagccgcgccccctcgtccaggacctcgtccagctcagggcgggaggtcagggggcggccggccaggaagcttttgaccaggtagaggacgcagttgctgacgcactggatgccggcaaagcggccaaacttgcagtgggcctggttgcacgaggccgtgcctaggatgcggagggccgagcctccactcccgcccccgggggcattcacatccatggtcctgattccgcgcacggggccggttccccgggggcgctggctttgcccccagtcgccgttactcatcttcggtggtgggacggggaggacgccttgtcgccccccttctggtccggggtcttacgcggctggcggcggcagccgccgagagataaggggggcacgtgtgtgcctccgcctctcctctgtctgggccgccgccgccgcttgcccgcctggaaggagagggggtagtccgcggactgcgtctgcgggggcaggaagtctcaaccttctgggctcgggccgcggtgtcgatatccgatggcctttccctctcttcctcgtatgctccttctcctcctcctcctcctcccggcacgcccctgagatctgcctcccctccctctccctcgtcctggtcggaaaagtctgaggaggaaaaggagaatggggaggagtccaaaacggcacgccacctgccgtggggcggtggtgacaggtcccggctggcccggcgcttgctcgcgttcctgccgttacccaggagaatggccgcgagttttttggcggggaggatgcggaatggcgggggcgtttgtcccacgggtgagggggaatcgtcggttagggccggcacgaggtggtgggtctggacccgggccgtgcgagcaaaggcagcgagaaccgaggggcttctgggggtgactgtgatctgttccggatttaggtccatggcgggtgtgtatgttttaataggggtggtctctggcgcggcaggatgatggtcgaggacgtccaccagggccttgcagatgcgcttgcctagatacaggatgtcgtccatgctgaggggagggggggtgtctgctcccccctgcagaagccgcctgggtgcgggggtgaagacaggtggtgggcgggcgtctcgccggactatggcctcggcacgctcggcgtcgatggcgggtggctggaacaggcgggcgaatgtgtaatcccggaaccggtaggcgacgctgcgcctgagggcgcccgtcaggctgtatcccagctccagggcgtgctccacccgctcgttgagctcctcgaggtccggacgcaggggctcgctggtgtgggcccagagggggtgatccgcgatgccccggctctccctgagggccggcaccaggaggcgccttctgagggtggccgtgtcggccgtggccagggcccacctggcggcggcgtcccggcacacatcctggatgccctccacgacgctctttagcgtctggaggtccgtggagtagtggcggggggagtatgaaacgctcttttccttcaccgctaccaccgcctcctcctcctcttccgtcgccagagggatctgcacccccccggtctctgcgtcgtacaggagcgggcgggagcacagcctccaagctgcccccgtcaagcgcgagatgtcctccgagagggtctcacccgagaccagaaagcggcgggtggccaggcccaacgactccgccgtcgtgctgtatctcagggtgaagaggagtgaaaagagggaggtgggccaggcaagcggtggtgcttccgccgcccgctctgaagctgagatagtctcggagatgatgcctgagacctctcggacggcgtccatgatcctaaggactgcgtcgtgggacgacagcccccaggggcccccgccctcttcgtcttctgcaccctcggctcctgcgtccccggccttgccttccccctctaagttgagggggcgcagtccgaccgcctggggggactccccaggcatcggaggggccccgtcatagatctcccagacggtggcgtatatgagctcgagaggacggcgggcccgggtcagctcgggggaagggagggccaggtcgctgccgaaggagaccagccagcgcagggcggccagagagcgggttttgggcagctcgttggagaggacccggcgaagggcgggccagatttggaactcgatgaaggcggccgggaagaaggggctgtggacataggccggatccgcgcgcgccgtttggccggccctcagggaccggcagtatgcctcgacgtctgtccgcggggccgccgccactgccgccgtccactgccttctcccctgctcgccggggagtagggggggcttacaggggagggccggagccggggccggggcctgccacaggcggctgtagcggacccatagcagagacctgaggagttcggatgaaaggtcccccgccacctgctcatactcggccgcgggaggggggacgatgaagatgcgcagaggggttacggcgtcccaagggtccgccgccgcccccacacccacagccgtcgcggcgggggcggcggcgggcgtagaggggccgctggtgcgccgggctcgtctgtccacggcctcggcctccgcccgcaggtaggccgcccgggccacacgggcgaagcggctcgtggggctcgcggtgggcagcagtcggaaaaagtgcagggcaaagcccgatagactctctaggagggcggcggtggcctcgagccacctccaccgcgagcgggacacccggggcacagaggccagcatcatggcgtagtcccccgccacggtctcgttgagcccggccgagagcagaaccgtggccacctgctcgatggcggctggagagaaggatgcccggctccccgccgcctcctgcacacgagcggccagggcctccatctctgccgccatcccggccaggaaggcctcgatgaccgagtctgggacgccgtaagtctggtcccagagcagggcctcgtacacatagtcgtaaaagagggcccctgagggctccaaaagccggagccgggcggcgtcaaaggccaggacgggcacagccgcgacggggggcgtttgtcccccgctggcctccgcgtacacgcccaggatctctaccgcccgccgccgggccaggggcagcgaggccaccacgctggaaagtgactcggggcggtgaaagagaccaccaccgccgctttcttcaccctctcccccgccggccccacccccactgtgctccaccagctccacggccatggccttgatgtccgcggccgtgggctgaccctgccctgcagccgcccaggggtagcggttggtctccgcgtatacggtgaccagccatctccccagcgtcgttttcgccgcgttaaaagcgtagaatgacagcccctcccgcgggaaggcgtcccaccgggccagataagtgtcggccaccagctcttccacgaaggcaaaggtggccgttgggccagagaccgcgagcacctccccgctgccctcttcgatgatgcgccggtacgcggccgccagggcccgggtctctgcgatgagccgagagccgtccagcggatcgtcggtggccggagaggctgtcgtggggggcagtgaggaggccagcacgtccagggccgcctccagatggccgaggccgaagctgcgcctggaaaaggaggccgcccggagtaggtagtaggcgtggtggcggaggaccgccgccgggtaagcgtggccgctcatgagggtgagagtatttaaaaaatcgcgcaccagcaccggctgggccaaatcccccagtccaaagatccccagctccagaggcatcagcgcgcgcaggcgggcagcggggtcgtccccagacagcagcaactgacgcgtcacgcgggcgagccccccgtccacctctgccaggggcggctgggcgtctgcccctccgctaccgccgctgctgtcactctccatagcggacgccatgaaggtccaggggtccgtcgatcgccgccgtctgcaacgccgaatcgcggggctgctgccccctccggcccggcgtctaaatatttcccgggggtccgaattcacgcgggacgttcgtgggctggttgaggaacacgcgcaggcctcctcgctgagtgcggcggccgtctggcgcgcagggctgctggccccgggggaggtggcggtcgccgggggtggcagtggaggggggagcttcagctggtctgggtggcggccgccagtctttggggactttctgatacacgccagctccttcaacaacgccgaggccactggaacgccccttttccaattcaagcagagtgacccgttctcgggcgtcgacgcggtattcactcctctctccctgtttatcctaatgaatcacggccggggtgtagccgcccgggtcgaggcaggtgggggcctgacgcggatggccaacctgctgtacgacagccccgcaaccctggctgacctggtcccggactttgggcggctggtggccgaccgccgcttccacaacttcatcacccctgtgggccccctggtggagaatataaagagcacctatctgaataaaatcaccacggtggtccacgggcctgtggtcagcaaggccatccctcgcagcaccgtcaaggtgacggtgccccaggaggcctttgtggatctggacgcgtggctctccggcggcgccgggggtggcggtggaggatgcttcgtcggggggctgggcctgcagccgtgccccgccgatgcgcgcctctatgtcgctctgacctatgaggaagccgggccgcggtttacgtttttccagtcgtcccgcggccactgtcagatcatgaatatcttaagaatttattactcaccatccatcatgcaccgctatgctgtggtccagcccctacatatagaggagctaaccttcggggcggttgcctgtctggggacatttagtgctactgacggttggaggaggtctgccttcaattaccgtggctctagcctccccgtggtggagattgacagcttttattccaacgtctctgactgggaggtgattctctagacttaacgggaggaaacaggaggaggagggggacaagagcacaaaagtggttcagtggacacccaccacacagcatggcaacgaccagtcatgtcgagcatgagctcctctccaaattgattgatgagttaaaggtcaaggccaactcagaccccgaggctgatgtcctggccgggcgcctgctccaccgccttaaggccgagtcagttacacacacagtagccgaatatctggaggtcttctctgacaaattctacgatgaggaattcttccagatgcaccgggatgagctggagacccgagtctctgctttcgcgcagagcccggcctacgagcgcatcgtctccagcggctacctgtcggccctgcgctactatgacacctatctgtatgtggggcgcagcgggaagcaggagagtgtgcagcacttttacatgcggttagccggcttctgtgcctcaaccacctgcctctacgcgggtctcagggcagccctgcagcgggccaggccggagattgagagtgacatggaggtgtttgattactactttgagcacctaacctcccagacggtgtgctgctccacgccctttatgcgctttgccggggtggaaaactccactctggccagctgcatcctcaccacccccgacctcagctccgagtgggacgtgacccaggccctctataggcacctggggcgctacctctttcagcgagccggggtgggtgtaggggtgacgggggctggccaggatgggaaacacatcagcctcctgatgaggatgatcaacagccacgtggagtaccacaactacggctgcaagaggccggtcagtgtggcggcctacatggagccctggcacagccagattttcaagtttttggaaacgaagctgccggagaaccacgagaggtgcccgggcatctttacggggctctttgtccccgagctcttcttcaagctttttagggacacgccctggtcggactggtacctgtttgaccccaaggacgccggggacctggagaggctctacggggaggagtttgagcgcgagtactatcggctggtgacagcgggcaagttttgtgggcgggtctccatcaagtccctgatgttctctatcgtcaactgcgccgtcaaggccggcagccccttcatccttttgaaggaggcctgcaacgcccacttttggcgcgacctgcagggcgaggccatgaacgccgccaacctgtgcgccgaggtgctgcagccctcgaggaagtctgtggccacctgcaatctggccaacatctgcctcccgcgctgcctggtgaatgcgcctctggcggtgcgggcacagcgggccgacacgcagggggatgaactcctgctggccctccctcgactctcagtcaccctacctggagagggggcagtcggtgatggattctcgctagcccgcctcagagatgccacccagtgtgccacctttgtggtggcctgctccattcttcagggatcccccacttatgattccagggatatggcctccatgggcctcggggtgcagggcctggccgatgtctttgcggacctgggctggcagtacactgaccctccctctcgctcgttaaacaaggaaatattcgaacatatgtactttacggccctctgcaccagtagtctgattggacttcacaccaggaagatttttccgggtttcaaacagagcaagtatgctggggggtggtttcactggcacgattgggcaggaacagacctttctattcccagggaaatttggtctcgcctctctgaacgcattgtgagggatgggcttttcaattcacagtttatcgccctgatgcccacctcaggctgtgcccaggtgacgggctgttcggacgccttctaccccttctatgccaatgcgtccaccaaggtcaccaacaaggaggaggcccttaggccaaaccggtctttttggcgtcatgtgcgtctggatgacagggaagctttgaatcttgtcgggggccgtgtctcctgcctcccggaggctctgcggcagcgctacctgcgtttccaaacggcctttgattacaaccaggaggacctgattcagatgtcccgggacagggccccctttgtggaccagagccaatctcacagcctgtttttgcgtgaggaagatgccgcgcgggccagcacgctagccaacctactggtgcgcagctacgagctgggcctgaagactatcatgtactattgtcgcattgagaaggccgccgatctgggggtgatggagtgtaaggccagcgcggctctgtcggtgccacgggaggaacagaatgagcggagtcccgctgagcagatgccgcctcgtcccatggaaccggcgcaggttgcggggccggttgacatcatgagcaagggcccaggggagggaccaggtgggtggtgtgtgcccgggggattggaagtgtgctataagtaccgtcagctcttctcagaggatgatctgttggagactgacggttttactgaacgagcctgtgaatcttgccaataaacgtttattgccatgtccaagttgttgtacgtgcgtgatcatgagggctttgcctgcctaacggtcgaaacccaccgcaaccgctggttcgcggctcacattgtcctcaccaaggactgcgggtgtctcaagctactcaatgagagggacttggagttttacaagttcctctttacgttcctggccatggccgagaagcttgtgaactttaacattgatgaactggtcaccagcttcgagagccacgacattgatcactactacaccgagcagaaggccatggagaacgtccacggggagacttatgctaacattttaaacatgctctttgatggggacagggcggcgatgaacgcctacgcagaggccatcatggccgacgaggccctgcaagccaagatttcctggctccgtgacaaggtggcggccgccgtcaccctgccggagaagattcttgtgttcctgctgattgaaggcatcttcttcattagctccttctacagcatagccctgctgcgggtccggggcctaatgcctggcatctgcctggccaataactacataagtagggatgagctgctccacacccgcgctgcctccctgttatacaatagcatgacagccaaggctgaccgaccaagggccacctggatccaggagctgtttcgcactgcggtggaggtagagactgccttcatcgaggctcgtggagagggggttaccttggtggatgtgcgagccataaagcagtttctggaggccacggccgatcgcatcctgggtgacattggtcaggctcccttgtatggcacaccaccccccaaggactgcccgctcacctacatgactagcatcaagcaaactaatttctttgagcaagagagttccgattacaccatgctggtggtagatgacctttgagtcagggtggctacttgctcaggtttctgggcataaattctcctgcctgcctctgctctggtacgttggcttctgctgctgcttgtgatcatggaaaccactcagactctccgctttaagaccaaggccctagccgtcctgtccaagtgctatgaccatgcccagactcatctcaagggaggagtgctgcaggtaaaccttctgtctgtaaactatggaggcccccggctggccgccgtggccaacgcaggcacggccgggctaatcagcttcgaggtctcccctgacgctgtggccgagtggcagaatcaccagagcccagaggaggccccggccgccgtgtcatttagaaaccttgcctacgggcgcacctgtgtcctgggcaaggagctgtttggctcggctgtggagcaggcttccctgcaattttacaagcggccacaagggggttcccggcctgaatttgttaagctcactatggaatatgatgataaggtgtccaagagccaccacacctgcgccctgatgccctatatgcccccggccagcgacaggctgaggaacgagcagatgattgggcaggtgctgttgatgcccaagacggcttcctcgttgcagaagtgggcacgccagcaaggctcaggcggcgttaaggtgacactcaatccggatctctacgtcaccacgtatacttctggggaggcctgcctcaccctagactacaagcctctgagtgtggggccatacgaggccttcactggccctgtggccaaggctcaggacgtgggggccgttgaggcccacgttgtctgctcggtagcagcggactcgctggcggcggcgcttagcctctgccgcattccggccgttagcgtgccaatcttgaggttttacaggtctggcatcatagctgtggtggccggcctgctgacgtcagcgggggacctgccgttggatcttagtgttattttatttaaccacgcctccgaagaggcggccgccagtacggcctctgagccagaagataaaagtccccgggtgcaaccactgggcacaggactccaacaacgccccagacatacggtcagtccatctccttcacctccgccacctcctaggacccctacttgggagagtccggcaaggccagagacaccctcgcctgccattcccagccactccagcaacaccgcactggagaggcctctggctgttcagctcgcgaggaaaaggacatcgtcggaggccaggcagaagcagaagcaccccaagaaagtgaagcaggcctttaaccccctcatttaacaccatgttctcgtgcaagcagcacctgtccctgggggcctgtgtcttctgtctcggcctcctggccagcacccccttcatttggtgctttgtctttgccaacctgctctctctggagatcttctcaccgtggcagacacacgtgtacaggcttggattcccgacggcatgcctaatggccgtcctctggacgctggtacccgccaagcacgcggtgagggccgtcactccagccatcatgctgaatattgccagcgccttgatcttcttctccctcagagtctactcgaccagcacgtgggtttctgccccctgtctctttctggccaacctgcctctcttatgcctgtggccccggctggccatcgagattgtttacatctgcccggctatacaccaaaggttctttgaacttgggttgctcttggcctgcaccatctttgccctgtccgtggtctccagggccctggaggtgtcggctgtcttcatgtctccatttttcatctttctggctttgggctctggaagcctggccggtgctcggcgtaaccagatttacacctcgggtctcgagcggagacgcagcattttctgcgcccggggagatcattcggtggcatccctgaaggagaccctccataaatgcccgtgggatctgctggccatctctgccttgaccgttcttgtcgtctgtgtgatgattgtgttgcatgtgcacgcagaggtgttctttggactctctagatacctgcccctctttctctgtggggcgatggcctccggggggctgtacctgggccattccagcatcattgcatgtgtcatggccaccctctgcaccctgacatctgttgtggtatatttcctccatgaaacccttggacccctgggcaagaccgtgctgtttatctcaatctttgtctattactttagcggggtagcggccctgagcgcagctatgcgctacaagcttaagaagtttgtgaacggacccctggtccatctccgtgtggtatacatgtgctgttttgtctttactttttgtgaatatctgttggtgacattcattaaatcctaacgaccggagtcctgtctctttgtgttcttgggggacttgagttagctgtctttcctcttattacattgggctaacgggaggaaatgaacccaggggtggcagtggatggggtcatttatgggcaaaactcacaggacatgtttggggagttagcattggcgtcgggaaacacagctctggcagttataaccgcaccagctaacaggacatgtttgggggagttggcattggcgtcaggagacacggctctgtcagttatcaccgtaccatgagtgccatgtgtgtccagtgcctaatcaccgttcctcattttgtgtgcctcctcaaatgttccagaagtcggccacaggggaggtggctgaattagggccttttccctcattcccccatgagacccacgtggcaggcctaggggctacattcgcctcccacgtttcccttcgcgtgaggcatccgatatgactgaattttcgcagtctcttttccctcttcccttgttattcccatagaattacagtgaggttacacaggtggagattcagtttaaccatttattgatttaatccaggaacaaaaaacagtcctagtgacccagtggccggagagagaatggccctgacaagtcggctgcatgatgcacttcggcagtcacgtgtgtgagtctccacggcctctgtcaaaagggagcttagcgtgccagggttgtaattcttgatgtagtggcccaggaattcaacttcatcgtgtctccgtctgcagttggcgttaatgtaggctggggctactgccgcatatgctgccaagagacagaggggctgcttcacatatgagctgctcagggtctccaccaccttgttttgacgggccgtggcacaggtgatgtagaagagttgcttcacaaagttgtagtctcgcgtgttaggaaggaagcagggtgccagctctttgagcttggtcaggatcaccttgctaagactcatggcgcaggccaggaggatgtcttccgcgggagctaggggcaggtcgccgtggtaggtgatctcctggagccaaaagatggtctcttctagcatggccaccagggtgcagagccccgcgttctggatcgcctgcatgcgtgcatccagccatgtgtccttgttggttgacttggtgaaaaactcacgtagtgtcttgtagctcctgcgcagctcgtgtctgggttgcactttctgccaggctccaatctctggatgggcggccaccgccagcatcgactgtaggaacgggtcttggatgggctctagggtcagagaggccagggggctgggcaaggtgacaaatgtaatcttggagacaggcttaaccagactcatgtcaaaccacggtttgttgggcaggggcctctggctgcgttcttgcctcgcctgcttccttgtgctcctgccggcccctcgagattctgaccggggacctctggttgctctgttgcttcggggagctcttggagacctcggtgctctaggcaccctgggggcccttggggctctgggcgctcttgctcccgggggcaggtgtcggcgcttgccataactttcatcggtgcagccatggacctctccgcgtcgccttttgtggcctctggtgtaagaggagttgccagtctcctccttctcgtcctcgtccctgcacaggggtgagcgatgcagcgtgaccgtcttgtcctgtaggtcccacttctttctgggaatcacaaacgatgccgaggtaggggttatgaccacgctggagggctgtgcaggtatggcgtgggccggagttggatcttcatcctcctcctctgaggatgaaatctctccatctgtggagtgttcttcgctgccgtccatagggtccatatcgcagtctgtgttggtgtctgagaccgcttcgagttccagaatgtggctctctgcagaggggagacaaaaggtggagactgccttgagcacctctatctcaggcaccggatgcccccggctccacggccccggcccctggccggtgtagcttcttacctgcgggatcctcgttggaggaaatgctgctagttcgggagagtctctgagaaggaaccatcttgtctgtctctacgacgggctagctgggatgtagtgctgtcttgactggcctcagccctatttatgattctggaggcgggcacgctgatggagaaatgggcggtcggttgattggccccacagcgaccggcgaagcactgactcatgaaggtgaccgtgatggcctgtgatgtgtagtagagtaccagaaacaccctcacattcttggagctggccctgtgggtatgcctcaggcacgcaaagttcctgccccgggcatggcacacctgaactaagtttggcccggtttgctcaaacgtgacatggagaaactgggggaatttgtcttctggcacagctgttgccagggtgctcatgagcgagggccagatgcaggagctgacccaggcgacgagatccaggcccagatgtccctctatcatggcgcagacattctccacggtggggggcagggtctcgcgggtcctctggattagatagtcacgcccatcatccgcgatgtggtagcagaaggttttgggggccggccagcccacgtgcagtgagtgatgtaagaggttttgaatgttgagggcattcttaacatagctgtgcttgtcttcctcttccggatgacagacaaagaggcgcagctgccggctaagaccaccgcccctgtccaccttgtaggtatgcggcagccggatgcaccgcccggcgtgatacacgccgctgtcaaaaagcggggccccaatctctttgatcttgtgacgcatgcggcgcaggcaggccgttaggcccatgagcttctgcagcacagacacaaacccttgtactgcgcttgttcccacaatagcatggcctctaggtagggtgtgatgacgacgaaagcccagttttcccgtgcatatgcaaaaggggagcacatcttccatattatccgggtcggcgggtggacaagctgatttgaaaaaatagactgggtgggccctggacactggacccaggcggcgcatgaggcgcagtacctcacgccgcacggtccggcacaggtcatagatttcctccagcgaccagggggggcccttgatctttagatccaggtccaggaccaggttgcagaccggaagccggggattaaagtattcatgccgggagacaaagagctgctcgctcaggctgttctgtgaatagtacactggggtgtaggagagggccctggtgagacacgtgtctgggaggcggcagttggtcggggtggagacgacctccgccaggtgggacgagaaggggtcagcggctgtcattacaaagtagtgcctgtctgcaaaatggcagaggaagaccggtagccgctgcacccttcgaaggacggtgggtgggaggaattgttccttgggattccactggccccggcaggtggcctggccggccaagcatagaaacccttgaagcgtgggggggtatgtgggaccctcatccgcgtgccagcgcgcgagctccaccagctcccgggccacgtccacactgagcccggcccaggcccgcatgagtccgtcatcggggtcggggtcccacgtgtatggggccgggggctccatgcggattttcagctgctggacacgcacatgctcagccaggtaagtctcccgggtgaagtaggtgcgcatgtgctccgcaaagcccctgtccaggagcgaggggagcacgacgccccccgaaggcagacacccaatttctcccacgctcgttaactgagagtatcgcttaaaggttccctcgttgaagcactgtgcgtgggccaaatagacgtagcgcacgagatcggccgaggccaggggaaggcgccccctgtaggcgtctatcgtccttgccacagtgcggatctctcgcgagtcccgccgcagcttctcgtgtgcaaagtgggcaaaagcctctgtctgctccgcccatgccgaggagccaaagacctcccccagctcggccagggacgtgacggcggccaggctctgaccagactcggaagtaaatagctccgtgaggtgcgccagggtctcaatcgtacaaggaatgccccaaaaatagtaagcagccgtgactagcacgaactgggcctcgtgggagccaaaggtgctaatgaaccacctggccgagatgttaacgcggtagatgcggcgcagacagcccacgatcttgggacgcagccacgccacgcggcctctggcatccccctgtggctgcttcttggcgctcagtgtgagcagttccacgaggggcgtgagcgagcgcagggcccccgcgcgatctaggtaggtggatagacggtccgcggtgagcggcgtgaggccgcgcaggaaggggaaggcctcctccgccggcaggcgcagcgtcagaaccaggccgcagcggctctgtgaggtcagccgcttcttgggcaggtgaagctgcagttccacgagagaacccgccacgtggtggaggggcgaggcgttgtggcacaaacaaaacaggcggaagccctcgtcaggccgcgagaggatggcatccaggatggcctccgcaatgtcagtgtttgaggccacaagggccttgatgacgacgggggtggacattatttaagaccgggaggccccaacggcgggctaaacagaacgatggccttctatctcccagactggtcgtgctgcgggctctggctctttggccggcccaggaatagatacagccagctccctgaggagccggagacctttgagtgcccggaccgctggcgagccgagatagatctgggcctgccccctggtgtgcaggtgggagatttgctaagaaatgagcagacgatgggctcactgagacaggtttatttgctcgccgttcaagccaatagcatcacggatcacctgaagcgctttgacgccgtccgcgtccctgagagctgtcgtggggtggtggaggcccaggtggccaagcttgaggccgtgcgctcagtcatctggaataccatgatctctctggctgtaagcggcatcgagatggacgagaatgggctcaaggccctgctggacaaacaggctggcgacagcctggccctgatggagatggagaaggtggccacggcgctcaagatggacgagaccggtgcctgggcgcaagagatctcggccgttgtctcatcggtgaccgccccctcagcctcggcccctttcatcaactccgcctttgagcccgaggtgcccacccccgtccttgcaccgcctcccgtggtgcggcagccggagcactctgggcccacggagctcgcgttaacgtagcaaccagactccacaccaaataaacattttattgataaaacaagggatatgaaggtgtcattgacccgaggatccaaaccccctcccctgtctcccctcgagcgcctcgctcagcccactatcacccatggccaggcccggcacctcctcgaaggcgcagctggcccacctaaagagagatctggggccaaggacccccgcgtcactgtgggggctgtagaaggaggtgaggtggtgcttgtgaaggtaaacaagctgacagaagcgccggtacttgttaaggaacacggtctggtcactaaagttggtcaggctgacgtccaccccaccccggcgccacctgcagggcttcactagaataccctgcatggccaggcccgacctgccaaagattgtcggcctgtggtgagggatagaaggggggggcacggtgagtgtcactgagacggtctgatgggggaagagggccaggtcctttggcaaagagacgtccaggcccacgtccccggggtactgggggtggttgatgggacccttgtcctcctccatctggggggtggcatatctgaaggcagccaggtggattttgagctccgatggacgcagcgtggagttgtagcgccgctgattctggaggattagccggagttcccccgtgtagccgggatcgatgatgccaacatgagacgtgaccggacgggaggtgctgccccacagcatgagcccatgaccctcgggtgggcgggcatagaggcctaggtccacagttgtggtcttcatcgggcgcagcaggatggtggtcttgttgaccaaggtgagccgccctacactagcctgctggagcaacagcttgtcattctggaaggcgtagcgtatgtgtggacaggcctccatggtgatgatctaacagacagggacggcggcgctatatataagagcccaagacccggctctctttactgcgaaatggggaaggtcctaagaaagccgtttgcaaaggctgtgccactgctcttcctcgccgccacctggcttctgaccggggtgctgccggccggcgcttccagtcccacaaacgcggcggcggcttccctgactgaagcccaggaccagttctactcctacacatgtaatgcggacacattctcgccttctttgaccagctttgcctccatctgggcacttctgacgcttgtcttagtcattatagcctcagccatctacctgatgtacgtctgctttaacaagtttgtgaacacgctgctgacggattagatggggatatttaaaaggggcagcaatctcggctgtctgtacttcttctctgctcgttaaaccaatagcatgtcagctccacgcaaagtcagattgccttctgttaaggctgttgacatgagcatggaagacatggccgcccgcctggctcgcctggagtctgagaataaggctctgaagcaacaggtcctcagggggggtgcctgtgcctcgtctacctctgttccttctgctccagtgcctccgcctgagccgcttacagctcgacagcgagaggtaatgattacgcaggccacgggccgtttggcgtctcaggctatgaagaagattgaagacaaggtgcggaaatcagttgacggtgtaactacccgcaatgaaatggaaaatatattgcaaaatctgaccctccgcattcaagtatctatgttgggtgcaaaaggccaacccagccctggtgagggaacacgaccacgagaatcaaacgaccctaacgccacccgacgtgcccgctcccgctcccggggacgtgaagcaaagaaagtgcaaatttctgattaataaatttttattgactttatacataggtctcggcgtcatcatatggtggggtggtgtaggtatgggatgtcgacaagttacgcctgaaggcgcagtccgccatgaccagcagcagcagaagggtcagcacagccagagatgcccactgcagtactagcatggagaggtttgagaatctgggctgggacgttggcgggacaggcacggtggcttgggctgtggtaaccggtgggctcgtaaaagtccagcggggccgcagtttgctagaagtgctgggaggtagataggtggtcgcattgtatctcggtcttggcgtagttgaatcatcgccgtaatctgtggtgggctctgtacttgtccgggctccatgtcctgtggtgtgctttccaccggtggtagaattggcctttccacctgttgaggtgaccgtgggaaccgccgtcttttggccactgggggcctggggcgacgttgcatttttggggggcgtgcctttggtgacattaacctcccccggttttgtggatgtggaactgtttccagggcctgacgcttggctggtggtgcctgggcggggcgctggcgaactggtggacacatgatgtgtgctgatagaggctggtgtcacctgtgttatattttcaccacctgttgggtgagcggaggttagtaaaggcatatgtgacgttgtctctgggattgaactgggtctcagtgacatggaagaggttgaacttgaagttctgttatgttggcctgtggtaacatcactggttgcattttttggtgggctggtaactactggggtgggacttgttcctcctaaggtgtggttggtggcatttgcctgtggacttgtttctcccacagtagggctggtggcatttggggttggggtagtcactgctggggtggggctggtggcatttggggttggggtagtcactgctgaggtgggacttgtttttcccaaggtggggctggtggcatttggggttggggtagtcattgctggggtggggctggtgccatttggggttggggtagtcactgctgatgtggggctggtcatgtcgggggccttactttctgtgccgttgtcccgtggagatggacttggtgtcaccggtgatgcgcctgacgttgtgccggctggtgttgggctggtgacatccgctgtggatacagtggggcctgtgcttgcaggtgcggtgaggttggtaggcacgtgagtagagctgggtagacctgtcgttgtattgggatcagcaaatccagttgtattcaaggtaggggaggtggtggtgctctcgggtgccttggagaatataaccttgtgggttgttgtggtggcattggtagccgttcgtgtgataatgagtgttttgggggccgtgccaagacccgagacagtaatgtcaaatgtccgattgctcgcaaatgcaccagaaatattttcacaacccgaaggtgtccccgaggtgagagtccatttgcacttaaagtcagtttcagtgttgtttggccaggcccaaaaggcagtcactgtaacatttggcgagtttgcgtcctcagaagtgaccattggcactgaataggtagcattgtcacccacatatgtgatgtctgtggtgtttgtcggcatgtcctgtgaagctggaatctcatcagagaacacaatgttggactgaatgcagtaatctcccccgctcgccttcggtccattcccagagtaaaacacgtacaggatactgttattgccaagaaatcgtgacactggacgtggtgtcagacgcaggctgtatgcataccctgtaccaggtattggggtggccacgggactcgttgatgtgagaattccgccgctgggaacatggctctcgtatccactgcaggtgatgttaaatttgttgtctccgggcagaacttgtgaaatttcgccatcctccataatacactcaatatctatctcattaccgagcatttgtgtttttacgctgaaattcgagtcttgagctgacgttggcaaacttaagggtaacgtgacatccagcccctgtgccctcactactgccgttatattggtagaattacagttatcccactttatgtatggcactgtttctggtatcaggtacacggggttttgcatttctgcatggtggcaccacatggttccaaacacatcttgaaagtagacatctacagattccaggcttacttgttgctcctctccggtggtgacgttaattggaagcttcttagaccgcatagttagagccaattctcctgcaccaaggagctccagtagaaagagattggtggcattttctgagccaccaaatgcacctcgaggttggtagacagccttcgtatggggtgtcagctggccaaagtcaagatcaagttgatgctttttgcccccgacatcgaaattgatagttacattgacatctgccgtacaaacattgcatgtggggtaaaatgggaattccggaatctcaacattgaaaaaaccaggatcttcacccgtgagatggatcaggctctggatggtgtactgacacacaagcaaggctgcctccattgtctcggcaccgatttctaggcagcatcctctttaataggtacaaggggggtgcggtgttggtgagtcacacttttgttgcagacaaaatggacaaggacaggccgggtcccccggccctggatgacaacatggaagaagaagtcccatctacctcggttgtgcaggaacaggtatcggcgggagattgggaaaacgtcctcatagagttatcagatagcagctcagaaaaggaagcagaagatgcccacctggagccagcccagaagggtacgaagagaaagcgggtcgatcatgatgccggtgggtcagctccagcacgacccatgctcccaccccagccggatctccctgggcgagaagccattctccgcaggtttccactagatctaagaacacttcttcaagcgattggagccgcggctacggtgagcatccctatggcctaggtgtgtgatgtgtgtttttacccatcacacaacaagaaggtaagtaatttgttgccgttggtttcagcgcatcgacacacgagccatagaccagtttttcggatcccagatttcaaataccgagatgtacataatgtatgccatggccattcgacaggccattagagatcgtcggagaaatccagcttctcgtagagatcaggccaaatggagactgcaaaccctggccgccggatggcctatgggttaccaggcatacagcagctggatgtacagctacaccgatcaccagacgactcccacattcgtacatctccaggcaacacttgggtgcacaggtggccgtaggtgtcacgtgaccttttccgccggcacctttaagccgccgcgatgtacccccggggatcgccagtggttgtatgttcagagctccgtgggtaacattgtacagagctgtaatccccgctacagtattttctttgactatatggctatacacaggagcctcacgaaaatctgggaggaaattttaacacctgaccagcgtgtttcatttatggaattcctaggatttttgcagagaacggatttgtcctatatcaagaactttgtcagcgatgccctgggcaccactagtatccaaacaccgtggatcgatgacaatcctagcacggagacggcacaggcttggaatgccggctttctccggggtcgtgcgtatgggctagacttgcttagaactgaaggggaacatgtcgaaggtgctaccggtgaaacgcgggaagaaagtgaggacgcggagagcgatggagatgatgaagatcttccttgtatagtgtccagaggtggacctaaggtcaaacgaccccctatatttataagacgtctgcacaggttgttgctgatgagagcgggcaaacgaacggaacagggcaaggaggtactggaaaaggcccgtgggagcacttatggcacacctaggccacctgttccgaaaccaagaccagaggtcccacaaagcgacgagacagctaccagtcacgggtcggcgcaagtcccagaacccccaaccatccacctagcagctcagggaatggcatacacattacatgaacaacacggcatggccccgtgtccggtagcccaggccccacctacgcccttgccccctgtatctccaggggaccaactcccaggtgtttctagcgacgggcgagtggcgtgtgcaccagtacccgccccggctgggcctattgtccggccctgggagccatccctgacacaggctgcggggcaggcctttgcacccgttagaccacaacacatgccagtagaacccgtccctgtcccgacagtggcacttgagcgaccagtttaccccaagccagttcgtccggcacctcctaagtttgctatgcagggccccggggaaacttctggcattagacgcgcgcgggagcgttggaggcccgcaccttggacgccaaatccaccccgttctcccagtcagatgtccgtgcgtgaccgtctggctcgtttgcgtgctgaggcacaggtcaaacaggctagtgttgaggtgcagcccacccagttgacccaagtatcccctcagcaaccaatggaggggccgttggtaccagagcagcagatgttccctggtgccccctttagccaggttgctgatgtggtccgggcacctggggtaccggcgatgcagccacagtactttgacctccccttaattcaacccattagccagggggcacccgtggccccgttgagggctagtatgggcccggtacctccggtaccggcaacacagccacagtattttgacatccccttaactgaacccattaaccagggggcatccgcggcccattttctccctcagcaaccgatggaggggccgttggtacccgagcggtggatgttcccaggtgccgccctgagccagagtgttaggccaggggtagcgcagtcacaatattttgacctccccttaactcaacccattaaccatggggcacccgcagcccatttcctccatcagccgccaatggaggggccgtgggtacccgagcagtggatgttccaaggtgccccccctagccaaggcactgacgtggtccaacatcagctggatgctttggggtatgcactccatggtcttaaccatcccggggttcccgtgtctcctgccgttaaccaatatcatctcagccaggctgcctttgggttacctattgatgaggatgagagtggcgaggggtccgatacctccgagccgtgtgaagctcttgatttgtcaatccatggcaggccctgccctcaggcccccgagtggcctgttcaagaggagggtggccaggatgccaccgaggttcttgatttgtcaatccatggcaggccccgccctcggacccccgagtggcctgttcaaggggaaggtggccaaaatgtcacaggccctgaaactagaagggtggtggtgtcagctgttgttcacatgtgtcaggatgacgagtttccggatctacaagatcctccagatgaggcctaagcaaaggtgtagaagtgtgtccccctccattccacccactgataatacgcccgacaataaagttgatgatattgaattccacacctgcttgtgtttgtgattttatttcatattccatgagagagacctcgcatatttgcagaagggtcactgaaacatcttatcttaaaacagttacacctgaataatgaagaaagcgtggctcagcagagcacagcaagccgatgccgggggggcatctggctccgaggacccaccagattatggagatcaaggtaatgtgacacaggtggaatctgagcctatttcacctgagattggcccctttgaactctctgcggccagtgaggatgatcctcaatctgggccagtggaagagaatttagatgccgctgcaagagaggaagaggaacctcatgagcaggagcacaatggtggtgacgatcccttggatgtccatactcgccagcctagatttgtggatgtgaacccaacgcaggctccagtgatccaactagtccacgctgtctatgattccatgttggtaagaggcacctagaacatttccagatgtttcgcttggattttttggccagtcttaattaattgtcattggtttcagcaatcggacctccggcccctaggcagtttattccttgagcaaaacctgaacatcgaagaatttatatggatgtgcatgaccgtgcgtcacagatgtcaggccatcagaaaaaaaccattaccaattgttaagcagaggcgttggaagctcctgtcatcttgcagatcctggcgtatgggttaccgcacgcataacctcaaagtaaacagttttgagtcagggggggacaatgtccacccggtccttgtgactgctacgctaggatgtgatgagggcacgcggcatgcaacaacgtacagtgctggcattgtacagataccacgaatatcagaccaaaaccaaaagatcgaaacagccttcctgatggcacgtcgtgctaggtcactttcggcagaaagatatactttgttctttgatttagtatcctccggaaacaccctgtatgctatatggattgggctgggcacgaaaaaccgagtttcatttattgagtttgtaggatggttatgcaagaaggaccacactcatatacgcgaatggttccgccagtgcaccgggagacccaaagcagccaagccatggttaagagcgcatcctgtcgccattccttatgatgatccgttaacaaacgaggagattgatctggcctatgcccgtgggcaggccatgaatattgaggctcctagactgccagatgatcctataattgttgaggatgacgacgaaagtgaggaaattgaagctgaaagcgacgaggaagaagacaagagtggaatggaatctcttaaaaatataccgcaaacactgccgtacaatccaacagtatacggcaggcccgcggtgtttaaccgaaagtcagatgcaaaatcaaccaaaaaatgcagggccatagtaactgactttagtgtaatcaatgccattgaagaggaacacagaaagaagaaggcagccagaacagagcagccaagagccacgcctgaatcccaggcccccacagtggtcctccagcgaccacccacgcagcaagagcctggccccgccggcccactgagtgtccaggctcggctggagccatggcaacctttgcctgggccccaagtgacaacagttctacttcacgaagaatccatgcagggtgtccaagtacatggttcgatgctagaccttcttgaaaaagacgatgaagtcatggagcagagggttatggcaaccctactgccaccagtaccacaacagccccgggctggcagaagaggcccttgtgtcttcaccggtgacctaggcatagagagtgatgagcccgcttcgacagagccggttcatgatcagctactgcctgccccaggacctgaccctcttgaaatccaaccactaacgtcccccaacacgtctcaacttagcagttcggcaccaagctgcgcacaaactccatggccggtggttcagccaagtcagactccagatgacccaacgaaacagtcccggccaccggaaacagctgccccacgccagtggccaatgccactgcgacctatccctatgcgccccttgcggatgcagccaatcccatttaatcatccagtgggacccactccccatcagacacctcaagtggaaataacaccatataagcccacttgggctcagatagggcacattccatatcagcctacaccaacgggtcctgctaccatgctgttgcgccagtgggcacccgccaccatgaagataccaccgagagcgcccactcccatgtcaccacctgaggtgccgcccgttccccggcagaggcctcggggggcgcccactcccacgccacctcctcaggtgccgcccgttccccggcagaggcctcggggggcgcccactcccacgccacctcctcaggtgctgcccactcccatgcagctggcactaagggctcctgctggtcagcaggggccgacaaagcaaattttgcgccaattgttaacggggggcgtcaagaaagggagaccatcacttaagttacaggccgcccttgagcgtcaagccgctgcgggctggcagccttcaccagggtccggcaccagtgacaagattgtgcgggcgcctattttctacccacccgttttgcagcccatacaggttatggggcaagggggttccccaacggccatggccgcctcagcggtgacacaggcacccacggaatataccagggaaaggaggggagtggggcctatgcctcccaccgatattccgccgtctaaacgagcgaagatcgaggcctatacagagcccgagatgccgcacggggggggctcgcactctcccgtcgttatcttggagaatgtcagccgggggcaacagcagactctggagtgcggaggaactgctaaacaggaaagggacatgttggggctgggggacattgcagtttcttccccttcctcttctgaaacatcgaacgatgagtgatttcgcccatgtaacaagaactgggatgaaccctggggcaacagactgcggggaggaggggggcagtgataagtcatgacaattttagatgaggtagaaattttgcatattttcagacccaccatggaatcatttgaaggacagggggactctatacagtcacccgacaatgagcggggagatgatgtacagactaccggtgagcatgatcaggaccctgggccggggcctccatccagtggggcttctgagggattggtaccagaagagtcagactcaagagatcagcaaccttgggggcaaagcaggggtgatgaaaacagaggctggatgcagcgcatcaggcgaaggcggagaagacgggctgccttgtccggccatcttttagacacggaagacaatgtgccgccatggttgcctccacacgacatcacaccatatatcgcaaggaatatcagggatgccgcctgccgggctgtcaaggtgagtatgcctctaactgggttcatgggggccatctaaggcccacgtgtgacccatgtttccattaattttagcaatcgcacctgcaagcgctatcaaacctgatactcgatagtgggttagacacacaacacgtcttgtgcttcgtgatggcagccaggcagcgtcttcaggacattcgacgtggacccttggttgcggagggcggtgtgggttggcgacattggcttctgacatctcccagccaatcctggcccatgggatatcgtacagcaacactacgcacattaactcccgtgcctaacagggttggggctgacagcatcatgttaactgctacatttggatgccacaatgcggcacgaactctaaacaccttctctgccaccgtgtggacaccaccccatgctggaccaagagagcaagaaagatacgctcgggaagccgaggtacgcttccttcgtggtaaatggcagaggcggtaccgaagaatctatgatttgatagaactgtgtggctctctgcaccacatctggcaaaacttgctccagaccgaggagaaccttttagatttcgtgcgtttcatgggtgtcatgtccagctgcaataatccagctgtgaattactggtttcacaagacaatcggaaactttaagccatattacccgtggaatgcaccacctaatgaaaatccatatcacgcgcggagaggcataaaagaccatgtaatccagaacgcatttcgaaaggcacaactacagggtttatcaatgttagcaacgggaggtgaacccagaggtgatgctactagtgagacgagcagcgatgaggacaccggtagacagggttcggacgtggagctagagtcctcggacgatgagctgccatatatcgatcccaatatggagccggttcagcagaggcccgtcatgtttgtgagccgtgtgcctgcaaaaaaaccgaggaaactgccttggcccacgcccaagacgcacccagtgaagcgcacaaatgttaagacctctgatagatctgataaggcagaagcacaaagcacccctgaaaggccgggcccttccgaacaatcatcagtgaccgtggagcccgcccaccctaccccggtggagatgccaatggtgattctccatcaaccacctccagtgcccaaaccggttccagtcaagcctacgccaccgccttcccgtaggagaaggggagcgtgtgttgtgtacgacgatgatgtcatagaggtgattgatgttgaaaccaccgaagattcatcgtcagtgtcacagccaaataagccacatcggaaacatcaagacggctttcaacgttcaggccgacgtcaaaaacgagccgcgcctcccaccgtgagtccttcggatactgggcctcctgccgcggggcctcctgccgcggggcctcctgccgcggggcctcctgccgcggggcctcctgccgcggggcctcctgccgcggggcctcctgccgcggggcctcctgccgcggggcctcgtataatggcgcctcccgtcgtacgtatgtttatgagggagcgacagctcccccagtccaccggccgtaaacctcagtgcttctgggaaatgcgggctggtggtgaaattacacaaatgcaacaagaaccaagttcacacctgcagtccgccactcagcctacaacgcctcgcccatcatgggccccatcagtctgtgccctctcggtgatggatgctggtaaggcccagcccatacaaagttcacacttgagttccatgtcgcccacacagccgatatcgcacgaagaacaaccccggtatgaggatcctgacgctcctctggatttaagtttacatccagacgttgctgctcaaccagctccccaggctccataccagggataccaggagccgccggccccccaggctccataccagggataccaggagccgccggccccccgggctccataccagggataccaggagccgccggcccccgggctccaatcatcttcatatccaggatatgcgggtccctggaccccaagatctcaacatccatgttataggcacccctgggcaccatggtctcaagatcccgtgcatgggcacacccagggtccatgggatccaagggcaccacatctcccacctcagtgggatggatctgcaggacatggccaggatcaggtctcccagttcccacatctgcaatcggagacaggcccaccacgtcttcaactttcattggtgccactggtctcatcctctgcaccatcatggtcatctccccagccccgagcccccatacgccccattccaacaagattcccacctccccctatgccgttacaagatagcatggccgtggggtgcgactcatcaggtacagcatgcccaagcatgccctttgccagtgattacagtcaaggtgcatttaccccactggacattaatgccaccacgccaaaaaggcctcgagtagaagaaagttctcacggacccgcccggtgttcccaagctactgctgaagcacaggagattctcagtgacaattctgagatctccgtgttcccaaaggacgcgaagcagactgactacgatgcatccactgaaagtgagctagattaaggggatccaaggtgacccctgttagctatttgatctttgactgacacataaacatggtttaaggaatgaacactcatggtgtgagactggaactgtactaaatttgctgacatatgtacaatgagagccaaaaatttgataaaccttaaaagtccccccatctaatgatgtccagttcccttctcccaccctgtacaccccgacccaaagggactcaatggcattcagatttctagttaccacaggtagaatatcgggcgttggcccataaaaataagtgcatggatatagctctgcacaggcttggaaacacccattccaggtgtgcttctttttggtgaaataaaaacagcatcctttatatgaaaatgtgtattctctggtgttgcagtatgtacagttagctttggtatagttttggggtacctgaaatgtgtgcagggtgggtgtccaatgtggcagttttacctctttgtccccatactcctgctcggctgtcttgttaaagttaaccggcggtggaggatccaccggccagacctctacatttggtttgggaacccaggtgatggccgcggctgccacccgccctcctcctcttaccctgggtggcaaaaagtatgccaggagtagaacaataacaagtgcgatggcggtaaacaatggcaccctcacctgcttaaacgaaaccatggcaaccacttcaaagagagccaacaggaagatatttattaatattccattagtaaacgaggcgtgaagcaggcgtggtttcaataacgggagttagaaatttaagagatcctcgtgtaaaacatctggtgtccgggggataatggagtcaacatccaggcttgggcacatctgcttcaacaggaggcgcagcctgtcattttcagatgatttggcagaagccacctgcggacaaaaatcaggcgtttagatggggcattttatgtttgggccattagccacctgggcattcgtgttactgtatactgacctcacggtagtgctgcagcagatgcttaaacttggcccggcattttctggaagccacccgattcttgtatcgctttatttctagttcagaatcgcattcctccagctgcgagcaagggaatgcgttactacaagtggtgcctagtcagttgaaacaggccccaccgtccgctgccgccctccttgagccccaccgtccgctgccgccctccttgatcccctccttaccgattctggctgtagtggtttccttgtacgtcgtgccggggcagccgctggtgcaggctgtggagcaccaatgtctgctagctgttgttcttggttagccccggggcaagccaacaccactgctgctgctggttgaacagtagaattgtctccaggttgaggtgcttctcccccggcttggttagtcagttgattctgggttatgtctgagactgggaacagctgaggtgctgcataagcttgataagcattctcaggagcaggctgaggggcaggaaaccacgacccagttggtgcggctgaaacatgataggcagtgagctggccttgtggcagaggctctggcagcaccggccacagcacacaaggcaaaggagcttgtgatggccctcccaggtcctgatagactctggtagcttggtcaaaagcttgtacaaaaggcacctggtatgggtcaggtgtaaattttacatcttcagaagtcgagtttgggtccatcatcttcagcaaagatagcaaaggtggccggcaaggtgcaatgtttagtgagttacctgtctaacatctcccctttaaagccaaggcaccagcctcctctgtgatgtcatggtttgggacgtgctaaatttaggtgtgtctctgaggcacattagcaatgcctgtggctcatgcatagtttccaaaagaggaggaggcagttttcagaagtgtctaaaataagctggtgtcaaaaatagacagcccagttgaaatatgcatggcatgcagcagacattcatcatttagaaatgtatccaagatttcattaagttctggggtcaggggggagtccagattcaaatcctctgtcatggactctagtgttgtggtcagttcgtccaaatggccacgagggggcgggtggttcaggtccatctgtccacatatggctgcttcctccttctggggaataacagtgtcagccatctcccttagggccttcacggcctgactggtttcctcatcagggtcctccaacagatgacttgcctcgggggttactgcgggggccgggtcaagtggcttgggcaccggggctggcgttagggatccgaccggttcatggacaggtcctgtgggggtgggagccaaagaggcaggcaggggccggttggcccacggggatccgggtggatggaagggcctgatcctctttggctgacacacctctcgcccctcgaacacgtcagatatggcactgcccgcttccggctttggcaggaacataccttcccggctatccctgaggcccttcttccttttaacgggaggaagaaaggtgggctttgaggggtgggggaatatgggtctctcatcgctctcttggtggaccgctgctatccaaggctgttcaggttcctccgcgttggaaggacatggagtttgaccacggttgggcctggatgtccggcgcgactttggggcccgcaggcgcggggcctcggccctggcctcttcccgctcgctctgctcggtgtcactgttgcccgagtcactgctgctggaactgctgtcaccgcagtcggcgctttgggcaccgggcttcaggggcatggtcgggctcgggagactttcgagttcatctgtaaaagcatgaaactgtccggactccgagtagcgggcctcggtgtgagaggcacccccatcattccccatgagctcctcgtccatcctgtcggctccggacacgaggataggagtttccactgccttggacttggttgacagcaggcacgcgggaagcacgccgctcacgtagctcctctgtccggcgtggctggagtaggaggcccggggcagtgtcttaatcagagccctgacatccttaacatcgtccgtcagatggcctgtcttggacgagaccatagtctggaacatctcctcgaggacgggataggtgaacacccacttgcaaaaggccttgaacttggagcttaggaggccttccttctccatcctgttcaggtgttccactacctgcttgccggaggccatgatggccgcgcggtccacgcccagcaccttgctgtaggtgtaggcccgcacccgactgtgttttaggagcttgtacatagcggtgcctatggtggcaggaatcatcacccggttgctgggggcctggatgaagaatctgtcagtgaccactatcaggtggtctaacacgtagcgcatcactatagggcacgcgatggaacatgcgtcgttgccggcattctcagcccgtcttcttaccctgttgtttcggagaatggcccaaaaattgcagatgttgagcgtggccattagcccgccccattctcgcccgtgggccttggcctcatttataaatgccttgcatattttgtaggatctcagagtaatctccacactcccggctgtaaattccttgttgaggacgttgcagtagtcagagaccagagagcccagctgctttttgatttcaggagttagcctcagaaagtcttccaagccatcctttttaggcctcatggctagtagtaacagaggaaatgcccgaccattaaaatctttcctccatgagctttacctgaaacactatcccgaagtgggggatgtggtgcatctactgaacaccatcggggtcgactgcgacctcccacctagccacccactcctgacagcccagagggggctgttcctggcaagagtcttgcaggctgtacagcagcacaagctgctggaagacaccatcgtccccaagatcttaaagaagctggcttatttcttagagctgctaagctactactcccccaaggatgaacagcgtgacatcgccgaggttcttgaccacctcaagacgaatcgggacctggggctggacgacagactctgggccctgattaggaaactgcgccaagacagacaccatgcctctgtaaatgtcctcatgccaggaagcgactacacagccgtgtcgctgcagtactacgacggcatctccataggtatgaggaaggtaatcgcggatgtctgccgcagtggctatgcctccatgccctccatgacggccacgcacaacctctcccaccagctcttgatggcgtccgggcccagtgaggaaccgtgcgcctggcgcgggttctttaaccaggtcctcctctggactgtggccctctgcaagtttcgcagatgcatttactataactacattcagggatctatagccaccatctcccagcttctgcacctcgagatcaaggccctctgcagctggataatatcccaggatggcatgcgcctctttcaacacagcaggcctctcctcaccctctgggagagcgtggccgcaaatcaggaggtcacggatgccattaccctgcctgactgcgctgaatacatagacctactaaagcacacaaaacatgtcttagaaaactgttctgccatgcaatacaaataaatttctcttacctgcgtctgtttgtgtagtgaggtgttgtgtcctgtatggtattctactttaaaaatgccggctgacatggattactggtcttttatgagccattggcatgggcgggacaatcgcaatataaaaccctgaccatcacatggggcattaggcgactctgcatcagcatcgcttaagtatgagtgggcagcagagaggctcggttattttggttcctgaacatctggctggggcattaactaagcttatgagcgattttatcacaggacaagatgtcactctttctggaggaaatattgcagtcaaaattcgcgatgctataaaccagacccccgggggtggtgatgtagctatactttcttccctgtttgctttatggaatgccctcccaacatctggtagacaatcctccagggacgatttaatcccagccgccgtgcaggccttaaccacggcccacaacttatgtctgggtgttattccaggtgagacctcacacaaggacacgcccgagtcattgctccgggctatcgtgacgggtctccaaaaattgtgggtggattcgtgcggatgtccagagtgcctacaatgtcttaagggattgaaggcaattaagcccggcctttatgaaatccctaggataataccacacactaagcagtgtagtcctgtcaatctcctgaacatgttggtccacaagcttgtggctttacgtggtcatgtgcagcttgcatacgacgcccgtgtcctgacgcctgactttcatgaaatccctgacctcgatgactccgatgctgttttcgcacgcaccttattggcagccttatttcacctcaatatgttctttattctcaaagattacataacacaagactccatgagcttgaagcaggcccttagtggtcattggatgtctgccacgggcaaccccctgcctgcagcaccggagaccctgcgaaactacttggaagctttccgaaattcggataatcacttttatctcccaacgacagggcctttaaacaccttcaaatttcccgaagagcttctggggcgcgttgttgtgattgattcctctttgtgtgccgccagtcacgttcaggacgttatcacccgtggtggtggggcgggtgttcctcgtcctaggtttttggccctgcccccggccccatcccgtgagccccagcagacatgctctcagttaacgagcagagggaatgaaagctcacggcgaaacttgggccagcccggggggacctcccccgctgttcccccagtttgccccatcgtttccctggcagcctcccgggccaagcaaaaccgcgggggcacgggatccttgcacttagcccagcctgagggaacctcccccgccgtctccccagtatgccccatcgcttccccagcggcctccaggtccaagcagcaccgcggggtcactggatcctcacaggcctcacccagctcttcttccgttgccccagtagcatctctgtctggtgaccttgaagaggaagaggaggggtcccgagaatccccatccctaccgtccagcaaaaagggggccgaggaatttgaggcctggcttgaggctcaggatgcaaatcttgaggatgttcagcgagagttttccgggctgcgagtaattggtgatgaggacgaggatggttcggaggatggggaattttcagacctggatctgtctgacagcgaccatgaaggggatgagggtgggggggctgttggagggggcaggagtctgcactccctgtattcactgagcgtcgtctaataaagatgtctattgatctcttttagtgtgaatcatgtctgacgaggggccaggtacaggacctggaaatggcctaggacagaaggaagactcatctggaccagaaggctccggcggcagtggacctcaaagaagagggggggataaccatggacgaggacggggaagaggacgaggacgaggaggcggaagaccaggagctccgggcggctcaggatcagggccaagacatagagatggtgtccggagaccccaaaaacgtccaagttgcattggctgcaaaggggcccacggtggaacaggaacaggaggggcaggaggggcaggagccggaggggcaggaggggcaggagccggaggggcaggaggggcaggagcaggaggggcaggaggggcaggagccggaggggcaggaggggcaggagccggaggggcaggaggggcaggagccggaggggcaggaggggcaggagccggaggggcaggaggggcaggagccggaggggctggaggggcaggagccggaggggcaggaggggcaggagccggaggggctggaggggctggaggggcaggagcaggaggggcaggagccggaggggctggaggggctggaggggcaggagcaggaggggcaggaggggcaggagcaggaggggcaggaggggcaggaggggcaggagcaggaggggcaggaggggcaggaggggcaggagcaggaggggcaggagcaggaggggcaggaggggcaggagcaggaggggcaggagcaggaggggcaggaggggcaggagcaggaggggcgggagcaggaggggcaggaggggcaggagcaggaggggcgggagcgggaggggcaggaggggcaggagcaggaggggcgggagcgggaggggcaggaggggcaggagcaggaggggcgggagcaggaggggcaggaggggcgggagcaggaggggcaggaggggcaggagcaggaggggcaggaggggcaggaggtggaggggcaggaggggcaggaggtggaggccggggtcgaggaggcagtggaggccggggtcgaggaggcagtggaggccggggtcgaggaggtagtggaggccgccggggtagaggacgtgaaagagccagggggaggagtcgtgaaagagccagggggagaggtcgtggacgtggtgaaaagaggcccaggagtcccagtagtcagtcatcatcatccgggtctccaccgcgcaggccccctccaggtagaaggccatttttccaccctgtaggggatgccgattattttgaatacctccaagaaggtggcccagatggtgagcctgacgtgcccccgggagcgatagagcagggccccacagatgacccaggagaaggcccaagcactggaccccggggtcagggtgatggaggcaggcgcaaaaaaggagggtggtttggaaagcatcgtggtcaaggaggttccaacccgaaatttgagaacattgcagaaggtttaagagttctcctggctaggagtcacgtagaaaggactaccgaggaaggaaattgggtcgccggtgtgttcgtatatggaggtagtaagacctccctttacaacctcaggcgaggaattgcccttgctgttccacaatgtcgtattacaccattgagtcgtctcccctttggaatggcccctggacccggcccacaacctggcccactaagggagtccattgtctgttatttcatggtctttttacaaactcatatatttgctgaggttttgaaggatgcgattaaggaccttgttatgacaaagcccgctcctacctgcaatatcaaggtgactgtgtgcagctttgacgatggagtagatttgcctccctggtttccacctatggtggaaggggctgccgcggagggtgatgacggagatgacggagatgaaggaggtgatggagatgagggtgaggaagggcaggagtgatgtaacttgttaggagacgccctcaatcgtattaaaagccgtgtattcccccgcactaaagaataaatccccagtagacatcatgcgtgctgttggtgtatttctggccacctgtcttgtcaccattttcgtcctcccaacatggggcaattgggcatacccatgttgtcacgtcactcagctccgcgctcaacaccttctcgcgttggaaaacattagcgacatttacctggtgagcaatcagacatgcgacggctttagtctggcctccttaaattcacctaagaatgggagcaaccagctggtcatcagccgctgcgcaaacggactcaacgtggtctccttctttatctccatcctgaagcgaagcagctccgccctcacgagccatctccgtgagttgttaaccaccctggagtctctttacggttcattctcagtggaagacctgtttggtgccaacttaaacagatacgcatggcatcgcgggggctagacctctggctggatgagcacgtgtggaagaggaaacaggagattggtgtgaaaggagaaaatctgcttctccccgacttatggctagatttcctacaactcagccccatcttccagcgcaagcttgctgccattattgcctgtgtccgacgcctgcggactcaggccaccgtctacccggaggaggacatgtgcatggcctgggcccgcttttgcgacccctctgatattaaggtggttattttgggccaggacccctatcacgggggtcaagcaaacggcctggcattcagcgtcgcatacggctttccagtcccccccagcctgaggaacatctacgcggagctgcaccggagtctgccggagttttctcccccagatcacggctgtctagacgcgtgggcctcccagggggtgttgctactcaacaccatcctgaccgtgcaaaagggcaagcccggctcgcacgcagacattggctgggcgtggtttactgaccacgtaatttcattgctctctgagcggttaaaagcgtgcgtgtttatgctgtggggtgcgaaggcgggagacaaagcttcactaatcaactccaagaagcatctggttctgacctctcagcatccctctcccctggcccagaacagcacccgaaagagtgcccagcagaagttcctgggcaacaaccactttgtcctcgctaacaactttttgcgtgagaaggggctcggtgagatagattggaggctgtagaggggtcataactatggccatgtttctgaagtcgcgtggggtccggtcttgcagggaccggcgcctcttgtcggacgaggaggaagagacttcacagagcagcagctacactctggggtctcaggcctcccagtctatccaggaggaggacgtgagtgacactgatgagtctgactactcagatgaagacgaggagattgatttggaggaagagtaccccagtgatgaagacccatccgagggcagtgatagcgacccctcgtggcatccttcagattcagacgagtctgactacagcgagagcgacgaggatgaagcaacccccggctctcaggcctcacgatcttcaagagtctcgccatctacccaacagtcttcaggtctgacacccacgccttcgttctcccgaccacgcacccgggcacctccgaggccgccggctcccgcgccggtcaggggacgggcctcagcacctcccaggccaccagccccagttccgcaatccaccaaagacaaggttcccaatagacctacgcgacctgtacttagaggcccagctccacgccgcccccctccaccttcaagtcccaatacatacaataaacacatgatggaaaccaccccccccattaagggcaataacaactacaattggccatggctgtaaataaaatgtcataacctggagtctgcatgtctgttgttttattcagtaaaccagtagtgcgcgtgagttctttagggcatccacgatgtagccgctcgcggggttcccctccccagtgatcatctcggataggggattcctgtccatgaccacgcaattagagtgccgggcccgggacagcgccacatacacatggccgggtttgatgtttctgtggctgccgaagcagatggcgactttgtttagggacagaccctgggctttggctatggtcatggccagctttgagctaatgccatagtcacggatgctgcagaggttcagggacttgtcctctatagtctcatacagcttgttagtattgtgttccaggcagcacacgaagcctgcctcatccttgaccattagcctgggcatgcgtgaactgccagcgtcctgaggctgctgctttcctcggatgccaaagaagacgttgagatgcgtgtagcccagaagcgtgtagttctcggtggtggaggcgtagtccaggaggccgtgaaggagaggctcgtctgaggtgaactctatgttgtcgcgaatcagcatgttgttggtaaatgtgcagaaggggaggtccctgaactcccttccgccatagcggacggccacatccaggcattgcctgaaataggccctgaggtcattatatatgtttaacagggagcagaggggggcagaatttgcggccgggggagccagtactcgggcatagaagacagcggcggggctccgctccccatcccaggcaacctccagcggcagttcgcccagctccatcccagcagtcacctccggatcccacgtacgcccgggcaggggcacagcaccaagctccgccacgtattccccgttttcacagagagaatgtcctccgtggctaaaagcgtagatgccgccgtaaatgagtcgggccaggaagctgtagacatactcgggctgctcatgcccgtgggcctccacgaagctgtccgcctcgagcgtgtccataaagtccccgaaggtgccggtatagccacagatggactttttggtcttgcagttgaccgacactgagctgtgcttcacgtaggtgacattgtaggtgaccttgacccgttcttcatcctgctcggttcccaccgggaccatgtcttggtcggcgaactgcgagtagttaccgaggcgtgcataattcttttggagccaggtgtgggccgtgaggcccggaagaccgaccagggtcttgtactgggccaggggatcgaggaagacctcgcactccaccgggcaggtaaacatggtcaccccgcccccatctcccccagttccccgcgcggcgcgcccctgcccggcagtcttgagcgtggcgtggagggtggtgaggaaggtcttgacctcggcgtgggagaggaagagccgggtccagcccacgtactgcgtggggtccattatggccgccctggggacgacgaagcggtcgacgtaggccaggatgtccggcgagagctcgaggccgtactcgagggtcttcatgaggtgtccaaactggacgtcggtgcagcgcttgttgttgatgaagagggcccagttgcgggccacgtccacgtaggtcgcggccctggggttgcccaccaggaaggtgaggatgttgtcgcactcgcgaatcttgtttacctgggtctcgtggctaaaggaggactgaaaggcgtctgtctgggtgggagagcccacgcagacgatgcagggaatgcggccccggcggtagagtggggtgcgcagccaggcgttgaagaaccagtagcaaaagaccacggctgttagaatgtgcacggaaagcgttccagcttcgtccaccacgatcacattggtggtccatagctgcccctggtgcatgtctctcaggacctcaaaggcggggccagagactcccgagtagagccccctgggcttggttcgcctgaactcggcggcaatgtcggagagtaccggccagtatttggccaggtcccgccgctggagttcctctagggcggcgtccgtagagcgaccatgactgctgacccgctgcgtcatatttatgtggcggctcttgaacccaaaggcgctatagacggttgggcagtaggctcggagtgtctgggagaggttctgtgcggccacggttgtggctcccgagaccaggcagtccatcgtgtggtggaggcagctaacgctggtgctcttgccagcccccgccgttcccgtaattacataggctgaaaagggcaggaaggggggctccgagagctccgggtcaaactcgggggagaacgtctccatatccgggagttgtaggacgcggcgcttagccagggtccctatcctcctgactatacgcctcacggaggcgtctgaggtcatgtttaacatgaacgtggacgagagcgcctctggcgccctcggctcctcggccattcctgtgcaccccacaccggcctcggtccgactttttgagatcctgcagggaaagtacgcctacgtccagggacagaccatctacgccaacctccgtaaccccggagtcttctcgaggcaggtgtttacccatttgtttaaacgagccatctctcattgcacgtacgatgacgtgctacatgactggaacaagttcgaggcctgcatccagaagcgatggccgagcgatgactcgtgtgcgagccggtttcgtgagtccaccttcgagtcgtggtccacgaccatgaagctgaccgtgcgtgacctgctgaccaccaacatctaccgagtgctacacagccgctccgtgctctcctatgagcgttatgtggactggatctgcgccaccggcatggtgcccgccgttaagaagcccataacccaagagctccactccaagataaagagcctgagggacaggtgcgtctgtcgggaattggggcacgagaggaccattaggagtatcgggacggaattatatgaggcaacgagggaaataatagagtcgctcaactccacgttcatcccccagtttacggaggtgaccatcgagtaccttccgaggagcgacgagtacgtggcctactacggtggccgccgcatcaggctgcatgtgctcttccccccggccatctttgccggaacggtgaccttcgacagcccggtgcagcgcctctaccagaacattttcatgtgctaccgcacgctggagcatgccaagatctgccagctcctgaacacggcccctctcaaggccatcgtgggccacggggggcgagacatgtacaaggacatcctggcccatctggagcagaactcgcagcgcaaggaccccaagaaggagctgctgaacctgctggtcaagctctcggagaacaagaccatcagcggggtcacggacgtggtggaggaattcataacggatgcctccaacaacctggtggaccgcaaccgtctatttggccagcccggggagacggctgcgcagggcctaaagaaaaaggtctccaacacggtggtcaagtgtctgactgatcagataaacgagcaatttgaccagattaatggcctagagaaggagagggagctctatctaaagaagatccgctccatggagtctcagctgcaggcctccctgggtcccggcggcaacaacccagcggcgtcagcccccgccgcagttgcggcagaagccgcgtctgtagatatactgacgggcagcaccgcctccgcaatcgaaaagctgttcaactccccgtccgccagcctgggtgccagggtgtctggtcacaatgaaagcatcctaaacagtttcgtttctcagtacatccccccttcgcgggaaatgactaaggatctgactgaactttgggaaagcgagctgtttaacaccttcaagttaacacccgtggttgataatcaggggcagcgtctctacgtcagatactcgtcagacacgatctctatattattgggccccttcacctatctggtggcagagctttcaccggtggaactcgtgacagatgtctacgccaccctaggcatcgtggagatcatcgacgagctctaccggagcagtcgcctggccatctacatcgaggacctcggtcgaaaatactgccccgcaagcgcgaccgggggagatcatggcatccggcaagcaccatcagcccggggggacgcggagcctgaccatgcaaaaagtaagcctgcgcgtgaccccccgcctggtgctggaagttaaccgccataacgccatctgcgtggccaccaacgtccctgagttctacaatgccaggggggaccttaacgtccgagacctccgggcccacgtcaaggcccggatgatctcgtcccagttttgcggctacatcctcgtgagtctgctggactccgaggaccaggtcgaccacctcaacatattcccccacgtgttctccgagaggatgatcctgtacaaacccaacaatgtgaaccttatggagatgtgcgccctgctctcgatgattgagaatgccaagagcccctccataggcctctgccgggaggtgctgggtcgcctgaccctcttgcactccaagtgcaacaatctggactctctgtttctgtacaacggggccaggacgctgctgtccaccctggtcaagtaccacgacctggaggagggggctgccacccccgggccgtggaatgagggcctgagtctctttaagctgcacaaggagctgaagcgcgccccatccgaagcccgggacctcatgcagagcctctttttgacctcggggaagatggggtgcctggccaggtcacccaaggattactgcgcggatctaaacaaggaggaagatgccaactcgggcttcacatttaacctgttttatcaagattctttattgaccaagcatttccagtgccagactgtcctccagaccttgagacgcaagtgcctcgggagtgacacggtctcaaaaataattccctagaataaactgagaacagtcatcagtaaatctgtctctcgagtgatttccataggcatggcgtagccggggtggagggccgatatcacatcaagcagaaaggccataatctctcgaaagtaggcggtggggctgagaccatgctcagtggccgtctggcagggggccgggcgcgctccatccttgtccaggagacacacgtggcttccagagaggcgcagcccagccctccgcagccgctgaagccaggctcgcggaagagcccaaaacctgtttcggcgccgcccaggggccagtctccgggtcaggtcgcggaccagggtcaacaggtggtcgtgggatggcggggccttgtctgcctcgggtctcgccgctagttggtccagggtccaggagaaggcttcgtgccagaccaaaaagggccccgagtgctccctacatccacccacgtaaagatccccctgaaagatggccatcagtaggcacgcgggcccgcgtcgagccttcacccgaatgtgtctgcgggccacggtggcctctccgcccataacatcccggtcgagccggctggcatcctccgagtctttcacaccttgcaggaaagcctaggtgatacagcaacagaaagctattagctggtggttcccccaccatcattcttcctgttaacgggaagaataagagttgggcaaaccccgggggccgcgctctcccacccagccccgctcctcacctgtgctagtggctcctctgaaggatgggcggaggttgttgccacaaagcccaggatgaactcgtctgcataagcccaggtcagtcctaggtcagcggccgcgtggaggagaacccgggtgacggcggtgtagaggcccccgagtgcccgtcgcgtgtctgaggtgccatagcggtgaagggcccgcagccaggtttgcgcgtcccgcgcctgccctccgccatcaggcgttcccacaggggcgcccctggcagagaggtggcagcgggccaattcgtagagccaccaagtggcatcagcctcaaggatggctgtggcctccgcgcgcccaaccaccgtcgtctcgtcctccccccctccctcgccgccctcccgcgtgcaaacgtggcgagggttaatctcctttcgggtcgggggccagatttgttgtaggagcagcgagccgcgtcgttgccctgaccgcgcgtcgaggcccaggagggcgtctgccaggggcgtcccagagactcccaggttcaggtccagtagcaggagaccctcgctgtgtggcgcccggtgccagaaggccggcctcgcccgtcccacataatggatgggcaggaagggaaagcccgggacatagggctggaaatctgagccccctgggcagagttcggggtccaggaggtagaagatgggcttggtgcctctgtggttggcgtagcaggaggcatagatactgcggaggaaggcgtagagcccgcccccggccatactccaagagttgacaagccaggactcgaatcccccagccggctcgagaattttcaggctgacgcggtgccgtcgggcgtccccaccacggccggtggccccgtcggacgacaccagatctacttcataagtgaccggtcgcaggatgtccctaaaggggacgggagaggggtcgtcgggagtctcggtggaataggtgaaaacatccccacgcggtgtcctgatgtatacgtccaactgtccgggagactcagagtgcctctgagcatgggggcatgtctgttccccctccacctcggacccgaagccatcaccaggtgggggttgttggtcccgcccatcatcccccgagcagctttggcagaccacctgtgctggaaagagaggctggaagatgaggccctgctcatcctccacccgggcagcggacaagagtctgcggtctcgggttctaaatgaaaggtcaaataggtccttctcggcggcatcggcgagcatagcaatgagccccccgctgcgcctgagctcccgctcccatcgcaaaaagttgagttcggtagtcgagggcgcgttgaccacggggggctccagggagcctccaagcggcggctggcaggcctgcaccacgatcagagtctcaacgtcctcccttttgatgggcacgatgcccacgacccaaatcgcccaccaccgccctgcggtctgggtgacattataaaaggtaaccgagctgacccgggccctgacgctctccgcgggtgtttccatcattgtttgagatctgaggaggactggaccctttaaaacatccggtcacgccctttgcaaattatttaaaaggtgaatgctcaactgagaccatcgcaatcatgaagtcctccaagaatgacacgttcgtctatagaacgtgggtcaaaacgcttgttgtgtactttgtgatgtttgtcatgtcggcggtggtccccatcaccgccatgttccccaacctggggtacccctgctactttaacgcactggttgattacggggcacttaacctgaccaattacaacctggcccaccacctgacccccacgctctatctggagccgccggagatgtttgtctacatcacactggtctttatcgcggactgcgtggctttcatctactacgcctgcggcgaggtggcgctaatcaaggcccgaaaaaaggtctcgggtcttacagacctctcggcctgggtctcggcagtgggctcccaaccgtgctgtttttggccatcctcaagctctggtccatacaggtcttcatccaggtcctttcctacaagcacgtctttctctcggcctttgtgtactttttgcactttctggcctcagttctacatgcctgcgcatgtgtgacccgcttctccccggtctgggtggtcaaggcccaggacaactctattccccaggacaccttcttgtggtgggtggtcttctacctgaagcccgtagttacaaacctgtacctggggtgccttgccctggagacgctggtcttctcgctcagcgtgttcctggccctgggcaacagcttttactttatggtgggggacatggtgctgggagccgtgaacctcttcctcatcctgcccatcttctggtacattctgacggaggtgtggctggcctccttcatgcggcacaactttggcttctactgcggcatgttcatcgcctccatcatcctgatcctgcccttggtcaggtacgaggccgtctttgtctcagccaagctgcacaccactgtggccatcaatgtggccatcatacctatcctgtgctcggtggccatgctcatcaggatatgccggattttcaaaagcatgcgccagggcactgactatgtccctgtctcggagacggtggaactggagctagagtcagagccgaggcctaggccctcgcgcacgccatcacccgggcgcaaccgccgccgctcttctacgtcctcatcttcctccaggtcaaccaggagacagaggcccgtctctacccaagccctcgtctcctccgttttaccgatgacaacagacagcgaggaggagatcttcccctaatgcaataaaaacttaaaacactgaggttactttcccgtcattctttcgggggaacgaggggaggcgggaattgggttaagataggggcgaagggtggggtgggtgcgagaattggggctggggagggagaggggagtggcctcggtgccgacgccggggtaccaagataatggattgagtaagcatggtgctctgatcgggtccgccgggttctcgggggtgtagtgggtgggcattgcatatttttgccgcggtgctgttgggccttggactcggggtgatcacccgcaccctcacccgcacccgcaccccagtccacagccaccggccaaggtcctgggcctcccaccaccgttatgcctccccctttacccattaattacaagagatgttagtttggtttttatttggcaaaaacagcaattcatcattttcagagtcctcatcatattcgagcccctcgttggtttccccgcaggccctcccttcttcgaccgctattagcttagtagtctccaggttaaactcctcatagtcattatacaggttgattattcccccgtccacgtcgcctatggagttgactcgtcgtcggcaaagagaccagagggcacccatggcgcggtgtcaaaagtattgtctgcgtacgctttccaggagccagccgcggtgctcaaggtcttacggatgacagagtccggcaggaccacgggtgtcaccagcaccgccacgggaatctccaccgaggcgtccagaagcaggtctgagccgagcgtgcaggtcgccgggtctagaggcgaccgttttcgaaagaaggccgtcacaatgttcacccggggtgagcagtctctcccgggcttgccacccccactgtggcggacgtagtctccaacaattttgtattggaggagcacctggtagaagtagttgtgccgtggattgatgaagatgttgactgggacccggtctttaataccaatgcgccccgcattttcgcttgggtccgtcattacgtagagcatagactccacccccctgttggcagctaggctgtctgccaccaggtcatgaccggggcccagtttgcgcttacggacatctttaagattccaggcctcatcctgcgtcaacagatagtcaccctccgagggcaaccgcccatccgggacgtactccacggtaggacgagctatagaattgataaatctgataaatgacctcttgcatggcctcttgtaaagcgcagtgtaggatgggtagatggggtcaaactctgacttggaaaagaggtacttgaagcggcacttaatctcataaatgcagctccggtcggtgaacagtataaagtctccctgtgactccacattgacgcaaagatccagagacaccccaaaaatgccatccgtgggactaatcataaagccaaattgacggttggcggatgcgtccccgcagatgagcttacagacaatgtccttgaccgtgtcctcacaccgcaggccaaaggcaacaggtcccccaaagtagtgatttgtggagatgggagctggctcaaacaccttggtgggtccattcttaatggtggagagcagcttggaagaggaaattatgccatttcgcaatatgtcccacatcaggttctcagactgccccctggtcatggactccacgtacgagcagagaacagtcctctgctcgtcggtggcctcctgtagcccccagtaaatggatttcagggagggaccgtcctggctgtcattctcttggactaacgaggagacaaagtcacagaagccagtttcaccagagaactcttgtatttgtttacagaggcaatagagatagacatagcgcatggccggcatctgaggtggacggtcaaggttacggacaaaggcctcagtctccggactgcggaggaagcgggcaaacgtgtaggaggtcatctcctccatgggatcctcgagctcatccacgtcggccatctggaccaaagaagtcgtctgccaagagttcagctaccagacctggaagatgagggtgctcaaaccgtgggcgacagttgaagaagtagctctccttgaacctctttttaaggctccggcaccactgcaagaattgactcatatgctccgccgtgacatccacgcacggactctcgccacacgaggtcaggcccatgtctaagttcaggttccacatctgcgacagcacctccaacagcaccacctttggggctgcaaattgcaaaaagtagagcgggtcggatcggtcaaatcccatgtcagggttggggtaggggattttgtgggtggagtcagcgaggtgcatgataccatagagcagcgagtagccgagcgactgcagatccaggcgaagggccgtctgcgcccccacggggccacacgccgaggggtcagggatgtgcccagcccccctcaagatgtagcacttgctcaaaaggcagaggggcttataggtgtccttggctatagaaaatggttccctctggcaatagaggcgatagagctgccggcccttagaagactttagccgcacatccagcatcttgttgcggtcgtggagggaagcagtcccataatcagtcaggaccagcctccccatgccccacatggtgtctgtgaaatccaccaggatgttgctggggctaatgtccgaatggaagaggccgcagtgccgattcaaaaagtaaacggcatctttgaggccctgaaagccccgcaccaggggctcaatactaccatcatgccagtggccataatcctggagactgcatctgaactgaggcataaacagggcgtggcaggacgtgcaggccgacaggtagtccaccagggccttgtcctgcccgtcctcggccgtggccttcccaatctgaatcatgtcacacaccatgagctcgtgatacagctccgtcacagagtcatagagtttgactgtggcattatctgcatgtgcatacacggccccgtagctcccccgccccagcagatactcgcaggtaatggggaggtgatcacagcgcgtcatgttctccggcagctttacatagagggtttccgtcatgtcatcaatgttggtcaccttcaggtgtttgtgctgaaaggtgaagtaatcaatgacagtcaccttccccaaaaaggcctgggtctctcgagggggttctggggagacactcaactcgccactgctggaggagttcgtcgggctcaactccgcagccatattcacatccatgttcctcaaatggctcgagggcctgtcgcagctcgtctctggcctcaagctcctgctcacggagctcctccacccgctctagctgcttgtagttgatttttggaaattgagtcttggtcgcggtgaccaccctctgataggtagaaattagctgtttggactcaaacgtctcccttgcgcggcgcagggactctaaggcaccccgagcagatgtaaactgtgtttcaaacagagcgtggtccctcccaaatctgtcacgtgcgctcacagccgctctcttttctaccgaggctcttagttgctgggccaccagatctcgcttagaactactcatcttcataagtcaccatgtccgcaactatggagccgagatcatacgtggggtagagtacggtagttccagtggaggcttcccggtaatttcccacagcgtccaccatatatctttctgcctctcccgttagaattaggcaaggatcatacgtgtccaccggccttttatactgagcgtttaggttttgtttatgtagcaagcacaaaaggcacacacgagtgatgcaaaagggttcctgaggcagcaggcagagctgttttgccattttattcaggcggctaacgtcaaagggaggagctatatcctcacccttccagtcacgcacgtccaagtacagggcatacacacacctggtgaggtgtgccaggaatgcctctatgttggcacatggtgtataaaccgcagtgggtagcagaatagggcccctcttgccccgtgctgcagcgtaaacacagtgacgctcttcgcagtgggacctggggccgtagaagagggcccacatccaagggagtgggtcttcaggcaccagggaggtccaggtatgggagtgggccaatatttgcaaggcctgacctataacctcatctttgttccaggccagcgcaattcgcataaggtccccatcaaacacctcaaaacacagacccatgcccatttcaggctgagagggctccatccggctcgaccacccttgtccaccaaactgccattcttctggtaaacgggggttgaggggcaagagctccaaagccaggctcgagaagtcatagtcatcctcggccacacggccggagctccgggcctcgtgccagggcctgttgtcctgagggaggatattggacacgagcaggaagctcttgagtggcgtctccaccagcttaaattgctcgggcgtgtcctggcaggcctccagtgccagttccagacactgcccatacctgcgggcgagcatcgggtcatcgggcatatcggccttgaccgcgttgaacatgctgtatgcctcgcagcgcggccgtctgaccgagaacctaagaaacgcccttcagcaggacagcaccacgcaaggctgcctgggtgccgagaccccgagtattatgtacacgggggccaagtcagacaggtgggctcaccctctggtgggcacaattcacgccagtaatttatattgcccaatgcttcgagcatactgccgccactatggccccaggcccgtgtttgtagcttctgatgaatcattacccatgttcggtgcgagccccgcccttcacaccccagtccaggtccagatgtgcctactaccagagctacgcgacacgttactgcgcctgctgcccccacccaatcttgaagactccgaggccttgacggaattcaagaccagcgtgtcctctgcccgtgccatccttgaggaccccaactttttggagatgagagagtttgtcaccagcctggccagcttcctgagtggtcagtacaagcacaagcccgcccgcctagaagcattccagaaacaagtagtgttacattctttttattttctgatctcaatcaaatctttagagattacagacaccatgtttgacatctttcaaagtgctttcgggttggaagaaatgacgctggagaagctgcacatttttaagcaaaaagccagcgtgtttcttatccccaggcgccacggcaagacctggatagtcgtggccatcatcagcctcatcctctcgaatctctccaacgtgcaaataggctacgtggctcaccagaaacatgtcgcgtccgccgttttcactgaaattattgacaccttgaccaagagcttcgactccaagcgtgtagaggtcaacaaggagaccagcaccatcacgtttaggcacagtgggaaaatctccagcaccgtaatgtgtgccacctgcttcaataagaatgtaagacctgacgtttcagtacttggcaattgtagagcatagcccggctgtaaaggtcagaaaatcgcagcagggtccaaggttgtgctgtacatgggacctctttcccattagcaagaaccccctgcaggacgcgtgacatgtccgggtgcattttgggtgggttaaatctcagtcccaccacaaagggggcatcctccggtttgaacatcagacccaacaaagcccgatgcccagttatgggtacgtagtcgttgttcagggccgtgcatggcagcagacaaggacaggtgccagatgtgcctgggctatcgtcctccgtccagccacgcaggatgttcacgtgggccccggcaccatagcatgtcacacattccccgttatcacatctggttagcaggttgataaaatgggtcagtgatggaaaggttggcatattggggcagcacatcagcatgtccatgttaacgaaaaacatgtacagggccccttctgcataccaggcaccaccccgtcccagtgggatgatctccgagggtgtgatatcttgcagttcttctactgttttaacggcggttgaggtggtaaagacgtgggccgtggtcagatctgtgcaggtgactacagggttacccctaatctccacaggcaccgcctcacccactgcatctgagaataccccaaagtacatgagagtcaggctgtgtggcccctggactgccttagtgaagagaacctcgggcctggccacggtggctagggttccattgatgtagacggtcacataggtgggcttcttcttgggcttcagcacaatgagggtaacattcatgtaggttttaggaggtccggctatctgaggcacgtacacagctgacacggcggttgtggccgtatagactttcatctggggcgtagaggcatcgctcagcacccagaggcactccttgttgaggaacttgcgaagctgttcccggctactgttcgcggcggatgccatgacgtgccagaatatatcccctctcctcgggggtgagtgccaattggcctttaataacaaagcccccaggcagcaccaaaaatgcctgcccgtccgatgtggtggccaggtggacgcagtgcccgtcagttccaagggctactagctgggaagcagccccaaccagcccaccgggggacctggagtcgatcaccttaccccaggccgaggccccttcctcatacagcgggtggctatctatccataggcaggcatccggcgtctttggtgcattggagatagctttcacccaacaactttcccaactaacccgtcgtctggacagtgaagaacgcttccctgatcaggtctgaatttttatagatacgggagtaggaggtgggaataacaactgggatttcttgttgtgctgtccaggcctgcatggccagtttttccctgaagctagcagaaattctgagggccactgaaatgaggaagcgaaactccctctctggagctcccaaaattgaaacctcagcaagatctgttgctggggaggcatgggtgacagctgtcatcctgtgcagtctgccctgggcactcagctctggatatgtgacaacatagagagcgtgggggctaaaaatatgagcaattcccctgaccagggccctggactcacgaatggcccgacgggtcttagagaaagaaacaggcaccctcgagggtgcccccgacccgacacccacagtgccgccagtccctgctcggcctccgccgccttccccaccggcgctgccccggatgttgctggggttctcgagggctgggtggtgcttgggcacagaggtctcagcagccgccttggtctcggccccggccctaagtctgagtcccaggcaaagggccggactcccagcgtggcccaacctctgctcccctctattctcctcttgcgttatctccaatagaatttgcttgaggtcatacgttttagggtgctcgacctgggccgcggccaccggcatatgctctatacccgcccctccggggggcccaggatctataggtatgggctgcatagccgcagcagactcctggaccccagaggcctctctgatcagatgcccgtcggtcagagcgcttttggccccctcaaagagagacaggtaataaatctgtagctccccaaccagccctccttcatcgtaaaatcgaagggcggccacgtggaaggggttgtagagctctggaaggccctcctcgcagtacactggcacactggtaaacgtgccccgatggctaggccgtccgggcagcatgccccgagcagcaaacacgcggcagaccctcgtgagacccgtccggtcactgaagagagtctggcaccaggccccctcgcagtttggcacgcgattggggcaaagctctgccataaccgtgtcgggaacaaataggtgcacgaggaggggggtcccgaggccactcaacacttggttgtcaatgtggacatccatagctctctcatgcgtttggctacagcatcatagcgcttgtttctggtggatttaaataacagggccccgtagacagtcttttgtgagtaaatagagatgatgacatggatgtagagactgaggaccacatccaccaccttctcggaggaggcccccctaaacagcatcaggcagcaagggaacacaaaggaaaccagggccgggatgtgaggcctcagggccccctcctgatcaaagagggcctcgctgaccccggagatgacattctcattcagaaagtagtgatagaggtgattgaccacagtcttaaccaggccctggacttgttcaggctcccacttgtcccgctggtcctgtgtgtcttgtcggatctcggtccagggcctcagcgccggctggaaatgcggccccatgtagttgcctgtaagggcgcacaccactccctcatgggtctcaatcagggtgcactcgctggatccatcacatacgtggtactcgccacagccccagcaggcaaacacggaggccatgctctcaggtaacgggagatggaactccagcttactatacgagcacaggtggcgaggattgggctcatccgtgcccccctccccccgcgggaggctcaatcggccttggtctgacattccaccccggccaggtccaggagggtgcaaatattctccaggcgctgcacctcagagacctcctgctcaaagagacctcccaccgccacgtagacgcgggccaccgtccggggaaggtcagtggggtcccagctcagcaattctccaaattctctctccccaatagtgactcgcttcttatcctgtctttcagagcatccgggggcagacatttcacctcttgtttgtggacgaggctaactttatcaagaaggaggccctgccggcgatcctgggctttatgcttcagaaggatgccaagattatcttcatctcgtctgtgaactcggctgaccaggccaccagctttctttataagctgaaggatgctcaggagcggctgctgaacgtggtaagttatgtgtgtcaggagcatcggcaagattttgacatgcaggacagcatggtctcatgcccctgctttcgcctgcacatcccgtcctacatcaccatggacagcaacatccgagcaaccaccaacctctttctggacggggcctttagcaccgagctgatgggtgacacctcctcgctgagccagggtagcctgagccgcactgtgcgtgacgatgccatcaaccagctggagctctgccgggttgacaccctcaacccccgagtagccggacgcctagcctcctccctctacgtgtacgttgatccggcctataccaacaacacatctgcatcaggcaccggaatcgccgccgtgactcacgacagggcggaccctaacagggtcatcgtcctgggcctggaacacttcttcctcaaggacctaacaggggacgctgccctccagatcgccacctgcgtcgtggccctcgtctcctcgatcgtcaccctgcacccccacttggaggaggtgaaggtagccgtggagggcaacagcagtcaggactctgcggtggccattgcctcaatcattggggaatcctgccccctcccctgcgccttcgtgcacaccaaggacaagacgtccagcctgcagtggcccatgtacctcctgactaatgagaagtccaaggcctttgagaggctcatctacgcagtgaacacggccagcctttctgccagtcaggtcaccgtctccaacaccatccagctctccttcgatccggtcctctatctcatctcccagatcagggccatcaagcccatccctctccgcgacgggacctacacctacaccggcaagcagcgcaacctctctgacgacgtgttggttgcgctagtcatggctcattttctcgcaacaacacagaagcacacgttcaagaaagttcattaaactttattgactacaccagtcccttgtaaagcgatgggtctcgcgtgacggcattcgtgagcagggcttcgtccaggggcttgttcttggtggacatcattagcccagctgcaaatatcagaattagcattagaaaagtgagtcccacaaacaccagtgtccagagaggaagaccgtaagataaagatggctgcctctcatctggaacggtgggaagctcagcagttgtttttgtggcattggacgtccctttggaggacagcgtgggggccaaggtggtagcgtttgtaatccgtgtagtagcactggcggtggtggaggacctggtggtgacattgctagtcacgcccgtggaggttcctgttccggactcggtggcagtgatgttctgtgcagtgaccttagtggtgacattgatggtggatgcgttggaagttgttgggactggtgtgacagttgtcccagtggatgtcaccgtggttgtgttggtgctcaggagagcagtcgtggttataggggcgctggtcgtggtcaaggtcgtagactggtttgtgctaggacccgatgccgatggtgatggtgtagtcacagccgttgtgcctgtcacgttccccgccgaggccgtcgaactgccactagatgtccagataaggcttgtctcacagatgagtatcatggccaggacagcgcctgccttgtctctggcgtgtgccatcgcgtctggacgcagaaggcctcccggcctcttttatagctagtctccacacccaatactctactgaaccatcacatacatgacctcctcgaggtatgcagggaatgagcggtccgtgagccggtcaacacgacattgcttccgtttcatgcctccagctgcccctgaccagttaggacccttgacggatgtctttaacggcgcggtgcagttggtcaccaatgacggcctaaaggccaacacatccttgaagcagggcgtaggaatggtaccaaactcggggcccaccccatcaaagacataatatgtctcatagtggcagtgatgatgcatcaccaccacagcactcgccaggaccctctgcatatcttgtacaaggcgcctttcaactcggccactggctctggtgacgttaaatgtcctgttcctattagtcacagcctgtagatttgggcacccagactcaaaaagtgcagctacatgaagggcagccgcctcaaatccaccatgacccccatggctgtccgtgttgttggggtaataagtcacattgttaatgaccacggccgggataagggtgtaaaccttgcagaatggattggtcggacacccataagacaggggcaccccaaaatcgcggcccttaccccgaagcaccttggcccccaccggcataaagctgggcaaaaagagtgggttaaaaccaaaggcgagtagggccaggaacgccaaatagcagcagtaatagatgaaaacaaagctcagcatgaaacagcgtggaggctcagctagggtctctgcctctccatcatagacatcttccttgaatctcattctctcaccgcatacctcactcttcatccaggagggggccatggctgccattctaccagttaacgaggagagagagagtaggtccgcggaaattggtgcccctctctgccctcctgacgaggccatggtgtcatccatctccgcagtccgttcttcagctttggcattggtccgtgtccgggtggtctgattctgattctgatcctgggtattggtcttggtctctcctcccccattggcatggattggcataggtgggtgtggctcaggctcaggttccggccctgggacggcagcagccgccgggacggtgaagtcgtggaaggtagaggcccgtccctcccgaggtcgtggggccggagccttataaaagacttccaccctctccccgctggccaagacacgccgctcgtggaccacgccatcttcctcccggctgattgtgtggctgacggtgccgtgttccaccgccacttgttcatcgaccatggtaccccctttatcttaaccagcaagtggccgtcagggtctcttgagagtatgccgctgtggccaagcgaggccccaaattaaatagtgatgccaaagactgtaggtaggtcatcatcacacgcatgcgtgataaatcatccgccactgacaggtcatccaggtctatccgggctatctcatccggcaccatctcctggaagagattcaagaggtcgtgatgctcatgccggataaggcctcggaccaggcgcatacttgccctgggcagcagggtcaccatgatgcaaaagtagagactcagattgtccagcagggccaagccaaggggccccggcacctccgggagggccaactcgtagtggtgccccaggtatgaaacagagccaagatgcatgtgtacatcgagcatgtctgcgttcccgggagcctgcatgacaacccgggagtacacgttaaacaggagaatcttctgcagcacctcctctgctatgggcgtaggcagcaccatggggaaaacaatgtccacatcattggactctaacttcacggtggcatgctctcgtccaaacaccgggggcataacactgaggctcccggtcccatgccactggaaaaagggctggtacttgttcttaatggcgtaggtctgacctggaacaatcttggtgagtatcaaactgtccacgctaacctcatccagcacggccagggtgcaatcagacaggtagttgtacatggacacgtagtccgggaccgtctctagagagtacacctgacccaagcccaatccctgcacattctgcgtcccgtgagtggaagccaggggtaagatgcagccaatcctctgttgcatcttggcaatctcatcggtatacagacgagaggagagagacactaccactttcaaatccatctttattgacaattatcaaaaaccaccttatttccaaactttaatattcttcgtaccggcgccacctcttcaattatatagtgtccgtaatggatgggggcgtgggtctgtttgacagacataaactcatcgatgagtgcccgggaggaggctgagagtgcggggaatgcctcctgcagaaagctgcagggctgctccagaaacacgtcagtgccagcaatcactacaaactgcacctctgtgttgctggtggctgggtgccctccaagtcgctggctgtactcgttgaccatgttgtagagccccctgttgttgcgcagaagctcctccttgttgaaaaatgcccggcaggggctgtagaggcctgggacggccgtctggcgataggaggagttgtacatgatgtcgcccagagaacccagctgagatgcccagggattcacagtgctccggtattcataggcggcatccgggcgagaatggtcatagatgagcccctcggcaacctcctgattgtagttttcacaggagaccacacaggcggcccgtccccttggagagttggacttttgaaaataagccacgtctgccgtgaccggtgttacgataatctcacaggtggcctgctggccgtggcagagtcctggagctccattaacattagtcatacctgccaggtatgtcctggggtcccgaagcagtgtcccattgcgctgagcgcccaccttggccttgatgtagtcgttgacttgctggttgccaaaggcctcggccggaaagacgctaaagaagtcttgggtgtggatacccatgtcagtagtgatggccgccaccctggccggagtcatggtcgagctataactaagcccggtgtcgatggaggccatctcgtgatgcacctcaaaggttaccgcgtccaccctggcctcccggcggctgacatttggggtcccaatgaacatggatgttgaggccctggagctaaacaatatgttttcagagaggatctcatcggtcctgaccacggtcatggccacccctgggtggatcttgagcttggcctgggcaatataggccatgggggacatcttgatgtgcatggcggtcattccactgattgaagcgagggaaggaagacattcggccgcgtatttgcccatgggcgagcggtgccactcccggtactctgcaaagagctgctctggccggttgaaggcttccacggcccgctgctgaggattgcgcataacaaaggtggcaacatcctggtgcatggtggcagccactcgcgggtccccgtaaaacatatggaaaggaatggcatggaagagacactgggtgacagcccgggtcctctcggagaaggcaaaggccaccagcccgttcaccaaaacagtctgctctgtccgcttgtcggcgggattcggggccagctgctgcgtaacgtcattgtccaccgacacacgcacggcgcgggtgaaagtggggcaggtcatgaatgaggcgctgaggtccctgatcatgcccacggtggggcggaggtcggagatctccagcagatccctgagcgtcccattctccaaattgtcgaggatgtcctcgtccctggtaaaatggtggctgaaggctggcccgttgtaggccagggtctgggccacgtgctgaaagtccaccccgaggccgcacatgtgggcattggtgcaggtcgggaggaaaacgtagtaaaagatcttttccagcacatccgcatgcccctcatctacataagggcctaggtgcagacggaaatcgtggtcgtggtccccgttaacccggtagccgtacaaggccacaaattgggcagccatctcatccatgtttccaaccctctcaataaactggggcgcggccagggtgtcagcgtaaacctcatttccgataataatctggggggcccggtcactaacggtgagaagtatgggtgaaaatgtctgtgtaggccaccggggggagcaggttagggtccaggagtgcgcagacatactgacccacgctctcatcccccacaacatctgacccggccaggcgcatcagggcctgctctagggctataagttccccatagatttttctatacatggaataggcctccttggagatggcgttatttcccaggtgacggcagatgaacttgatcatggaaaagctgttcacaaaggcaagcctccctgcccgttcccagtaggtgttgatgcacagggacaccaaaggcacgttcatgacaaacttttcctcaaacccgtggatcatagcctcaactacgtagaagaaggctggataggcagtgtcataggcagtatcctgcacagtctcaataacggcctgatccaccacgtgggccagagatgtggcggtctcaaactgctgcccccgggcctcttggaatgcagctggggccaggggagtcggcaggttacccaccattagccggtgcacggccctgtgcctggccctctccccggcatccctgccaatgtaaatatcataaagggggtgcagctccagccgcagcaggtcataattggacgggtggaggaagtcttcggtgggcagcccgcacttgagagctatatctgtcacgggggctgcatacttgttatcatagaactcgtccacaataacaagcacattcatgtgattgggcctcctgtgttgcagggagtaggtctcgcgcctgtctcgcggggccggggccgcgttgaggctgtttagggtatgggcgggtgtgtggagtcgggggtgacagagaaccttgagagcattctgtaggttaaacgcgaggagaaggttattcttgtttacgatccatgcctccaccggtagctgctgtgtggggttgtccagcattttgatggcggcggaggtcgtatacttgggattgggcataaacaggcccactgggaaatagtagctgtactgcattcttctgttgagggggtatggggactgagtgtcattgtacatcttttgcaggctttccacggccaccgcgtggttgcccagcttgatgacggcggctgagatcggcacccggggctgatcctcgacccctgcggccacagccggcaggtcagacttggtgcttccggctttttccggtgagtccacgatcctagccatgaaatgctcaaacgtacgcatcacgcgcccgtagctcacggcagtgaccaggttctccccccgtaccacaaaagaagcatagctcgagggccccatgatctggttgtcggcctcctcacccaggaaggtcaagagctggcgcagaacgttgtcggtgacaataaacaccccccccactggctctccccccttggcggtcgtgtaggtactgacccccttgagcacgctctccccggacacggccgctaccatctcagagagacggcttcgcacgtactgagaaaacccggagcccatgttctcggcccggtccaggaagaaggagtgctccagcagatgcctcttgaacatggcaatgaggtcagacttgacagtcttggagaaccccctctcagtgaaggtgggatccgccagggtctgcaggataaacatgggaggggcgtggcgaagcttcacactcaggacggtgttaatgaggcccctctccagggcatcgaccccaaactgtagggccgaggccacggtcttgacagcccccacgtactctgcgtactcgaccggggtctcggggatactatgcaggatctccagatccagcatggacagttccatttccgtactaatgtggtgtttgtggcaatttttgaccacaatgaatgtccgctgcttgctgggtctccttccgtccccgtgagcaatggtggggacggagattcgaaattgaatcttgccatccgtcatacgactcaggtctttgaattctgtgttcacacaggacacggccagtgccgtctccaggaagcgaacatattggatggcgttcgtgtagaccccgagtagcacctcaaacttgatgcccgcctctctggcatccttgcccaccagcaggtcaaagctatgaaacagcccctcggccgctgactgccgcaggttcgagagcaggtcggcatccaccgtcagataggggaagggtctgttttccacaccctcatttgaggccatgacacaaggtaagagggagatggggggaggtctcgagggcttctcttcacagctgggtctcttttacgccctggcctgcaaccgcagcccacctgcacttcccgaggatgctacccttctaatcaaatggttggacacggccctgggcagggaggccaccttttacgcgtgtcgggctatgcgtcgtcttctactcggcgttatccgaataaatgactgccaggagctgccacccggtttaataattctgagtccgggcaccgtccctggcccccttggagtccagagtctggagcatacagactgcgaaatatggtcctctgcccaccctgaccacgctgcccacctcccggtgcccagggtcatcacatacaccgactgcccgggttccataagcacgagctcaatgtttcgccttatcatccgctacttgtctcatcaccaatttgagcgctgcttcgagcagttctgccgcgtggtcccgcgtcgcttcctagggacctgtaagcaaaactctgcaaagatgctggctcatctgaagcaggttaccaggatccccccctgtccgcccttcagcgggcgggaggccagactcaagttccacttcttctcctggagcacattcatgctgtcatggccaaacaatgccacactccgggagatcaggacgagggccgccaccaacctcacccaccacccacatctagtggacactctgtaccacgcctctccgcagaccccatttctgacacgcagcggtgctctataccgcttcgtcacctgttgcaactgcaccctgcccaatatctccatccagcagtgcaaggccggggacagaccgggggacctggagatcattctacagagtaacggcggagggaggcctgcgagcttccagttcccctcctccccaaccggcgccctattgcgatgcatagttgctgcggccctgctgccggaggtgtccgtggggcaccaggagctgtctccgctcaggtccagaagccagggaaggcagacggatgtcaggtcgggcccggacccggcacggaggctggtggccctcctgcgaagggaagatggggcacctaaggacccccctctgggaccgtttggacacccccgggggcccggcccggccaagagcgaagacgaggagtctgagcgtcgagacgcccctccacccccgctcgatttcagcttccaagcttcccggttggtgcccgtggggcctgggtttcgcctgctcgtgttcaacaccaatagggtgatcaacactaaattggtgtgctcagagcccctggtgaagatgcgagtttgcaatgtcccccgcctcatcaacaactttgtagcccgcaagtacgtggtgaaagagacggcgttcaccgtcagtctattctttacggacggggtgggggccaacctagccatcaatgtcaatatcagtggcacctatctgagcttcctattggccatgacgtcactgcggtgcttcctgcctgtggaggctatttatcccgcggccgtgtcaaactggaactcgactctagatctccatgggctggaaaatcagagcctagtcagagagaaccgaagcggggtcttttggactaccaactttccctcggtggtgtcctgccaggacggtctcaacgtgtcctggtttaaggccgcaactgccaccatatctcgagtgcacgggcggacattggagcagcacctgatccgtgaaatcacccccatcgtgacgcatcgagaggcaaaaatctcccggattaaaaaccggctctttaccctgctagagctacgcaatcggagtcagattcaagtgctgcacaagcgtttcctggaaggcctgctagactgcgcctccctcctgcgcctggatcccagctgtatcaaccgaatcgcctccgagggcctgtttgatttctccaagagaagcatcgcccactccaaaaaccgacacgagtgcgcgcttctgggtcacagacattcggcgaacgtgacaaagcttgttgtaaacgagcgcaagacccgcctggacatactgggccgtaacgctaactttttaacgaggtgtaagcatcaggttaatctaagacagtcacctattttcctgaccctcctgaggcacatccgccgacgtctgggcctgggccgtgcttccgtaaaacgagagattacccttctcctggcccacctgcgcaaaaagacagcccccatccaccgccgtgatgctcaagtgtaagcagcccggggcccgcttcattcacggggccgtgcacctgccatcgggacagattgtcttccacaccatccacagccccactcttgcctcggcgctgggactgcctggggaaaatgtacccatcccggccctcttccgtgcctcgggcctcaacgtccgtgagagcctacccatgaccaacatgagggcaccgatcatctcgctggctcgcctcatcctggcccccaacccctatatcctagagggacagctgacggtgggcatgacacaggacaacggcattcccgtgctttttgccaggcctgtcattgaggtaaaaagcgggcctgagtccaacattaaagcctcctcgcaacttatgatagcagaagactcctgcctgaatcagatcgcccccttttccgcatcagaacaccccgccttctccatggttgagtccgtaaaacgagtccgggtcgatgagggagcaaacacccggcgcaccatccgggatattctggagatccccgtgactgtgctctcatccctgcaactgtctcccaccaagtccatcctgaaaaagacaccggagcccccacctccggagccccaagccaccttcgatgccaccccctatgcccgcatcttttacgacatcgggcgacaggtgcccaagctgggcaatgcccccgccgcgcaggtcagcaacgtgctcatcgccaaccgctcccacaactctctaaggctggtgcccaatccggacttgctgcctctccagcatttgtacctcaagcacgtagtgctaaagagtctgaatctggagaatatagtgcaggactttgaggccatcttcacctcccagtctgataccatcagtgaggctgaaaccaaggcctttgagaagctggtagagcaagccaaaaacaccgtagagaacatagtcttttgcctcaacagcatctgttccacctctacactcccagatgtcgtccccgatgtcaataacccaaacattagcctggctctagagaagtattttctcatgttccctccctcaggcaccattatgagaaatgtcagattcgccacccccatcgtccggctcttgtgccaaggggctgagcttggcaccatggcacagtttctaggaaagtacatcaaggtcaagaaggaaaccggaatgtacacactggtcaagctttattacctgctgcgcatctaaaggaaaaacataacaatcttgtgaaccagaaagatacccagagcaaaagcaataaagtacaggattattgccaaaacaacgtgtgctctttcttcatacaggcccgcaatttccatgacagtcccgttggtggtcagcagcagatagtgaacgtggaggttgtcaaaatcaaagtagttggagctcaagatggagttttggacttcctgggaggtgatgtaggttgtagtttccaggccttccttttcatcataactgagcagggcaaagccacaaaaaatgcaggatttctgcgtcctggtaaaattctggatctttggaatctggcggggctccccagccacagcaccctgcgaacatttattcattataacgggggagagaaagagagagctgctgagataggtggtgctggcctcgtatagcgccgagcctcggacctcacggtcactagagattatgaatgtcacgttgatgagcgggataatcatcagaactttgtcgagcctgtccacgcatttgtaggcggggagatgccacgcatccctgtcttctcgctccaaagagagacgcccaagaaacccatccacagcatttgaaacggccgcctggtccagcattgcctcctggggggccatgctcagcagcttgtctcgtgtgaggtcaaatcgtaggctgaggtagcacggtgagaagagcccgctctccgtccccagggctagcccccgcaaaacctccccaatctctagggccgagcacagggcggtggacagcagttggtatagggcaaggttgggcccctgggtagtcacgttcagccgcaactcgcgtagcaccacgtggctgccgataaacagggtctctctcatcacggtatgcaggggctggaaaagggggtggcggttgtaggccgagagaagcacagatgtggcgcctccaatgaggccactgtaaaccccggccttggggtagccgacggtggctaacctcagcgcgtactcctgtttctcagtcgtcaggtgaccaagctcctccatcttgaccgtggccatcagcatggcggccaagcgctccagcccgtaggattgcatgcccttgaccgtggccccataacatatgccgatgatgtctttcaggacagtcagctcaaagaagctcttggccaaccagcggaggtccacgcagccattgccagtctcacccacggcatgacccaccttaaagaaggccacagaaacctcaaacatggtagtcagcgtttccgtgtccagttctggctcccggcagcctcccttcatctccagcaggaccagtttctggagaacgtagcgagcgtagctggcggctgtcatggtgacggctcgggaaaacatatccttcaggttgggtacaaagtagttgtgaaagttggcataatgcacaaaggttgtaacaatcaccagggaatagtccccgctttgggcactggttaaggatgggtaactaaaaggccccctcagatccggcaggtccttcgtcttgccaaagatcaggctcaacacatgctcatctcccttctcggtcactcgcttgtaggtgcccatcagaaatttagaagtcatggcccccgtgtactgaaacttgtccccgttgatggacagggccacataagacaagtgacagcgcagctgataaaagacatagctgtgtggccgcgtgttgggcagcatggtgccaatatagtagaagagctgcttctcaaggggggcactaagcatgcaggcaggggaattcaggccgctaatgactccgggatggaccttagatgcatccacttgcatggatccttcagagacagcagggatatcgacaggctcggccagcgcaataccaagggtaccagacgtcttgtaaattaacttgtagcggttaagcatagacgccaaatcttcggtgacatttgcctctctccacagcgcctctgggctaaggcctgggacctttgccatcagttcggtccatgggatggtgtaatgcgaagcatgcccctctatgtccaggtgcagcttaacctcgctaaggctggcagcccccacctcccatagcaacaccaggcaaaaaacacagagcaactgcatcctagtcccgatttcccctctcaaaatcagagatcaccttgctcagaccagcccaatcgaaaaactgagatcgtattgccggattcttcaatgcctgcatgtaaatctccgtccagcatccaggtaaatcgtcctgaaactctgagaggtccacaagcacaaactgaaggtaggctagcgttcgggtgaacgcaagacaaacttccaacaacaccgcgtcggctcggaaaggctgtatgacttccttaagtacactaaagatgctgttcttatacagcttctcggccacaccacttcgaattatgggggtgtggctttgatgacatactgtcgtgattgttgttagaccggcacataccttcacaatgtcctcgggggcaaaatactgtgttaggagccaggcacagtaaacggcgtgatatgcatcgttgacactcttcaggtagccagcatccagtcctgactcatgtttcctccctcgcttcttcaggcggcgcatgttctcctccacgtttaacttcatccagactatggtgtcccccgggtctgcggtaaacgtggccaaaacttgaataaagtcactataggagagaagctggctccggagcagcattagagggaaaaccacggaggccgacagcaaatggcgatcatgcaaaatccaacaatccaggggcgcgactgacctggcaccagactcggtaaccagcaagctccgcttcctagaggccaagactctgaaaggggtagtaaatttcatctggcatgctaaaacctcagccgacgtgtcttcccttccatgcctcgcccgagtcacattcttgtgcatggccttaatggcattttcatacacatgagtccagtaccgcatcggttcagggactacaatggtcaggtccccaaagacagccttcaaatgattcagcatagtagtctttcccacaccaggggcaccttccaaaaatagggaacaggcaggtttgattactggtacatgatttgtcaggtgggtcacaattggaacccgcgtgctctccttcctctgagccttggcctggcgggtgtcttgggcatcatccagattcagaacattcatcacactcccacttagccgcttcagctgggcagcatgcttggataacttactaaactcacgcccatgggcggccaggtgttcgaagagaccagaaggcttacccttgccaccattcttttgttttaacgcggaatgagaagagggcctgcggaaattagactcatcctcagactcacagtcagatttgtcatcgagcccaaggccagccaggccctcctcaaagcctttctggtacatgaagctccggctcgtggagtccgcacctccttctgtgcacgaagttttgcggaaccaggagaaggggtctggcgtcttgctggggccacactcccggctacggggcttcggggtaggggcagtaggcttttggtgtgcgggtgccggtggctgggctcccctgggtagggtaaaggggcacgatgtgtgccggctacccggagagtttccagtattagatgtcacggcagcctgggtccggcacggcaccctctccccagacagtccggtcggagccatcaaggggggccagtgggtgggcacctggtagagtccgtcatcatcttcctcacctgcccctgagtcactgccggttggggtaagaactgagggggcaaagtcatcaatctcagcgtaaaagttttcgtgtctttcgttttcaggggactcatcctcctgacattttcgccagccgccgggcgggccggcctcctttcctggaaatccagccatggatcccacccgaggtctgtgtgccctctccacgcacgacctggcaaaatttcacagtctccccccggctagaaaggcggcaggtaagcgagcgcaccttaggtgttactccaagctgctctctcttaagagctgggagcaactagcctcttttttgtctctgcccccgggacccacgtttacggactttagactatttttcgaagtcaccctgggtcggagaatcgcagattgcgttgtggtagctctgcagccttccccccggtgttatattgtagaatttaagacggccatgagcaacacggccaacccgcaaagcgttactcgcaaggcacagaggctagagggcaccgcccagttgtgtgactgtgccaattttcttcgcacgtcctgcccccccgtgctgggcagtcagggcctggaagtcttggcggcgttggtatttaaaaaccagcgatccctgagaacgctccaggtagagtttccagccctgggccaaaagaccctccccacctccaccaccggcctgctaaacctcctctcccgctggcaggatggcgctctccgggcacgtcttgatagaccccgcccgactgcccagggacacaggccccgaactcatgtgggccccaagccttcgcaactcactgcgcgtgtcccccgaagcgctcgagctggcagagcgggaggccgaaagggccaggtcggagcggtgggacaggtgtgcccaggtgctcaaaaataggctgctcggcgtggagctggacggcatcatgcgtgaccacctggccagggcggaggagatccgccaggacctggatgctgtagtggccttctctgatggcctggagagcatgcaggtcaggtccccctccacgggagggcgctctgcgccagccccgccctccccatccccagcccagccgttcactcggctcaccgggaacgcccagtatgcagtctcaatctctcccacggacccccctctgatggtggccggcagcctggctcaaacgctgcttggtaatctgtacgggaacatcaaccagtgggtaccgtccttcggaccctggtaccggaccatgtcggctaatgccatgcagcggcgcgtgttccctaagcagctgaggggcaacctgaactttaccaactccgtctccctaaagctgatgacagaagtggtggcggtgcttgagggcaccacccaggactttttctcagacgtcaggcacctgccagacctccaggctgccctgatcctctcggtggcctacctgctactccaggggggctcctcacaccagcagcgccccctccctgcctcacgggaagagctgctggagctgggcccggagagcctagagaaaatcatcgctgacctcaaggccaagtcacccggcggaaattttatgattttaacaagcggaaacaaggaagcgcgccagtcaatagcccctctcaaccgacaggcggcatatccacccggcacattcgcggacaataagatttacaacctgtttgtgggagcgggactactgcccacgacggccgcgctgaacgtgcccggggcggcgggtcgggaccgggacctggtgtaccggatcgccaaccagatctttggggaggatgtgccccccttctcatctcaccagtggaacctgcgcgtaggtttagccgcactcgaggccctgatgctcgtctacacgctctgcgagaccgccaacctggccgaggcggccacccggcgtctacacctatcgtccctgctcccccaggcgatgcagcggcgcaagcctgccgtggcgtcagctggcatgccgggcgcctatccagtccagacgcttttccgccatggggagctcttccgcttcatctgggcccactacgtgaggcccacggtggcggcagacccccaggcctccatcagctctctttccccgggctggttttgctggccctggagctgaagttgatggatgggcaggctccctcccattatgccataaacctgaccggacaaaagtttgacaccctctttgagattatcaaccagaagcttttatttcacgacccggctgccatgctggcggcgcgcacacagctgcgtctagccttcgaggacggcgtcggtgttgccctggggcggccctcgcccacgcttgcggcgcgggagatcctggagcgtcaattctccgcctcggatgactacgaccggttgtacttcctgacgctgggctacctggcctcccctgtggccccaagctgagccagttcctcgcactggagtgggtcattggcaaagaggtaaataaagtcatcgcacgggggttttgcctccttctcgtctcttgtttcgggtaggggagtaaggccgtgccaggccgccatgctcagggccacggcgtgccagaggccctcgtagtcgtgcgcatccgagaggatggcacggtccagaagcagatagccggccaggcagaggaaggccacaaagagggggcgaaggcgggcccgaacccgggtttcatgctcatctgccccccagtgaacaaggcagtagaggacacccaccaccaggcggttagggaggacactgccaaggttgaagagcagatttccgtcagccagggtgacctggctcaggtccggcgccctgcgcagtccaagctgcgcccacacacatgcacagacggcccctgtgacatcaggccggtcatgcaaaaacagacaaagagaccgtgagcggttaccggggcgcagggcctctgccgggaagcccacccgtgccagggcccggtaaagcaggtaccagtattcatccggcaccttgcgtgccaacacacgattcgtgcggtttccagtatttatcacggcttcccgccacaggtaaaagttaacacttagggtcagcagcttggtcagggataggtgcaaaaacctgagctcgtcctcgcgcagagcgcaaagcggccagttctttagcatcttcaggaggagcccgtgaatcccaggtgtcattcgcgcgtcatccccgcgaacccccagtcccattaacatagcgggcacaatggtgcaggcaccgtctgtatacgtctgcggcttcgtggagcgcccggacgccccacccaaggacgcctgccttcacctggatcccctcaccgtcaagagccagctccctctgaagaagcccttgccactcacggtggaacacctgccggatgctccggtcggctcagtctttggcctttaccagagccgagcgggtctctttagcgcagcctcgattacctctggggacttcctgtccctgctggactcaatttaccacgattgcgatattgcacagagtcagcgcctgcccctccctcgagaacccaaggtggaggctctgcacgcctggctcccctcactgtcactggcctccctccacccagacataccccaaaccaccgcagatggaggcaagctgtccttctttgaccatgtgtctatctgtgccctgggtcgccggcgcggcaccacggcagtctacggtacagaccttgcgtgggtcctgaagcactttagtgacctggaaccgtctatcgccgcccagattgagaatgacgccaatgctgcaaagcgtgaatccggatgcccggaagaccaccctctgcccctcacgaagctcatagctaaggcaatcgatgctggatttctgagaaaccgcgtggagactctgaggcaggacaggggtgtggccaatatcccagccgagtcgtatttaaaggccagcgacgccccggacctacaaaagccggacaaggcacttcagagcccaccaccggcctccacagacccagccaccatgctatcaggtaacgcaggagaaggagcaacagcctgcggaggttcggccgccgcgggccaggacctcatcagcgtcccccgcaacacctttatgacactgcttcagaccaacctggacaacaaaccgccgaggcaaaccccgctaccctacgcggccccgctgccccccttttcccaccaggcaatagccaccgcgccttcctacggtcctggggccggagcggtctccccggccggcggctactttacctccccaggaggttactacgccgggcccgcgggcggggacccgggtgccttcttggcgatggacgctcacacctaccacccccacccacacccccctccggcctactttggcttgccgggcctctttggcccccctccacccgtgcctccttactacggatcccacttgcgggcagactacgtccccgctccctcgcgatccaacaagcggaaaagagaccccgaggaggatgaagaaggcgggggactattcccgggggaggacgccaccctctaccgcaaggacatagcgggcctctccaagagtgtgaatgagttacagcacacgctacaggccctgcgccgggagacgctgtcctacggccacaccggagtcggatactgcccccagcagggcccctgctacacccactcggggccttacggatttcagcctcatcaaagctacgaagtgcccagatacgtccctcatccacccccaccaccaacttctcaccaggcagctcaggcgcagcctccacccccgggcacacaggcccccgaagcccactgtgtggccgagtccacgatccctgaggcgggagcagccgggaactctggaccccgggaggacaccaaccctcagcagcccaccaccgagggccacccccgcggaaagaaactggtgcaggcctctgcatccggagtggctcagtctaaggagcccaccacccccaaggccaagtctgtgtcagcccacctcaagtccatcttttgcgaggaattgctgaataaacgcgtggcttgaaagtaaactttattgcgtgttagtaactgtccattcacaggggtatccagcccttgcgccgcctcccccagcccgccagccaccccagacaggagatgataatgatgaggagcaccggagccaccacagcacaagtgattaggagcagggcccagtgcacccaggtggtcttagggcgccagggatcgattggaaaagggcccagggtcactggcttatgcgtgggacgtttagaaacaggccgcctatggggcctgtgactggtgcttgtggtgtgggagactaatgtggtgggggctatggtagtggctgggataacagtaagatgcatacgctgagtgagcgtccggttggcatggtattggtcgtcttcttcccctgcagagtaattgcagtggaccccggaggccacactgcaatttctcagtgtcacattgcacgtgtagtaacctgcatgcgcaagggtcacattggggattatcagagagacggaggtgttggagtcatttacccattctagggtaaggctataattgtaacccccgttagttatatgagttccgttgttggaagtagctacggccaagggcagttgtccatccccgggagtgtatccccggcccaactcgatccgagagaccgactcattgctaggaacgctgcaggtgagattcactctagcacctgcatgggcggtgacattttcaaatttaaccagatctgagaaaaatgcacaaacagaccccacacagcagcacaatagaagcactaaatgagtcattcctaaactgtcagttttaaaactccctgcttctcaggcctaaatacgtggtggggtgtgcttaggatcactttcatattctgcaacaacagccatacccggaagaggagctgccggttgccatttttcaagctgctaaaccacgagtggcagcaggcctaagaagctcctcagcaacatggagacctcgaagggaaactggcaggagcagggagtcacgtaggcactagcctcttcatgtgaggtaagagatcgctaaaaatgggatcagggtatgtaaaccgagttttgcgggggatggtgagccagacacggcgggtggggggaaggagctgacacgagtgcgtagaaagggccaaaaatacaccagctataaggaattgctcaggccaaagttgttcctcaggtggctttaggcctaatgtaggcaattgcgtgcctagaacattgctaatgtgccctgtgtttcctgccttcatgcaaatatcctacctcccccggcctggtgcaaaatgtctgcctcagaatactaacagctaatccaagctaacattctatcagtaaacgggcagaaaacggataaggaccgcggagtttggccctccgcggtgtccggtggtcctcacacgtgccccccccgggccgatggctgaggcccggaatatgcaagtgcatctttctaaccagtaggggcctccacctaggtgctttgttaatctttagtgggaactagtgggagtgctgtgcctagggtacccctatcctagaggtcctaccggagctccttgtcttgataatccctgtaaacacacaccacctaagaacaaggcatcgttaacctttggtggaacctagtgttagtgttgtgctgtaaataagtgtccagcgcaccactagtcaccaggtgtcaccggaggctacttgcctcagtgccacttttaccttctcaaatctatacgggggggggctctgtaacatttggtgggacctgatgctgctggtgtgctgtaaataagtgcctagcacatcacgtaggcaccaggtgtcaccagggctacttgcctcggcatctcctcaccggagaaggggttaacaaacccgtggggggtcttagtggaagtgacgtgctgtgaatacaggtccatagcaccgctatccactatgtctcgcccgggctatatgtcgccttacctcccctgtatagtcacgaccccaccgaaccaggcatgatgtagaataaaattttatgcatcgtcttctaatctgtgccgcttggagggaaacatgaccacctgaagtctgttaaccaggtcagtggttttgtttccttgatagagacacaaggactgccagccccgttggggagggggtggtgggtacgggagaatttgggctcgtttaaacaaagcctcctctgatgctctgtggcacctcaaggtgaatatagctgcccatcgacgtatcgctggaaaccggtgggccgctgttcacctaaagtgacgcaaggtctgtcagccgccagggtccgtttaccaggctttcaggtgtggaatttagatagagtgggtgtgtgctcttgtttaattacaccaagatcaccaccctctatccatatcccacaattgataaacctccgcatgtccaaccaccacgttgaacaggatgtggcaccctaagaggacgcaggcatacaaggttattacctagtccttgtatgcctggtgtccccttagtgggacgcaggcctaggtagcatcatttacactaaaagcagtgaccttgttggtactttaaggttggtccaatccataggcttttgtgaaaacccggggatcggactagccttagagtaactcaaggccaagcatttcacacctgcaaatgcaccatgtaaccacagatctaaactgaaagttgcagctttagatggcaaggaaacttgggtttcaggcatagaaagcctggctcactatagcagcccatgtttgttccagggtgggggaaaggcacatgcccttagaaaacttagctgcaaaaattctattgtgttgggagagcctccatatctaaaggcctttcctcacaatacaaatgttactaacgtctgccctctggagacctgctatgtggctagacgtatggcctacccaagacgttgggggtctcgggtaggccatgattcttccaggcataggttacaaccagtcactgctatcaagcctactcagttcccaacgcagcacataccccccgcctctcctgccatgaggacttatggcagtgtttactgttctgcttttactcttggaccaggctgtcattctatcagaataacaggggaagcaaggccccctgcgtcagcgggacacgtgtttctagaatctcggagccaataactacctgcccctctaatctgtatgctgcatgaaaaaccacatacacgtgatgtaagtttagccagtttattgttacaccaatgccccgaaagtctccccctgtcgctttgggtctcaggacccagccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccggggttccggccctggagctcggggggcggccgggtggcccaccgggtccgctgggtccgctgccccgctgcggcgggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgccccgctccggcggggatgggggtgcgctcccaggccggaccctggtgccaggcagggaccccgcgccacccgcttcatggggggggaggccgccgcaaggacgccgggccggctgggaggtgtgcaccccccgagcgtctggacgacgctggcgagccgggccggctcgccttcttttatcctctttttggggtctctgtgtaatactttaaggtttgctcaggagtgggggcttcttattggttaattcaggtgtgtcattttagcccgttgggtttcattaaggtgtgtcaccaggtgggtggtacctggaggtcattctattgggataacgagaggaggaggggctagaggtccgcgagatttggggtaggcggagcctcaggagggtcccctccatagggttgaaccaggagggggaggattgggctccgccccgatatacctagtgggtggagcctagaggtaggtatccatagggttccatgatcctggaggtatcctaagctccgcccctatataccaggtgggtggagctaggtaggattcagctaggttcctactggggtacccccctaccctaccttaaggtgcgccacccttcctccttccgttttaatggtagaataacctataggttattaacctagtggtggaatagggtattgcagctgggtatatacctataggtatatagaacctagaggaagggaaccctatagtgtaatccctcccccccctacccccccctcccttacggttgcctgagcccatcccccaccccagcaccccggggtgacgtggccccccgcgtgccttcctgacttgtcacctttgcacatttggtcagctgaccgatgctcgccacttcctgggtcatgacctggcctgtgccttgtcccgtggacaatgtccctccagcgtggtggctgcctttgggatgcatcactttgagccactaagcccccgttgctcgccttgcctgcctcaccatgacacactaagcccctgctaatccatgagccccgcctttaggaagcaccacgtcccggggacggaagctggattttggccagtcttcaattttggggagtggttttgtgtgagccggaagttggcaatggggtgagggcggcgctggttaagctgacgacctcccaaggtctctcaccctgggtacacaggtggggcggcagcctctaactttggctgtggcctctatttcctccctttcctagccagggccatgtgttcctgcatgtctacttgcctcctgtggtggcagagcttggccctgggcccaacccccgccttgggagcctgtaggggccaacacccttggtttgtttgtgttcctgtttgctggcaacttactggcagccgagcagattctaatgggcgcccgccttctttctctcttgttttattaatagaatctcagccaggacctatacctgagacttcaaagtctggtcctgggttctgagacccccaagatttgtcatgcacacctgcacacctgttggtattgggtttctattcttgagtgtgaaagtttgtaaaaaaattcataaaatgtcactaattcctcttacctgtttagggtattgtgcaattcttcagcctgcctattttcaatttgcctaaggtggcaatttaagatgtggttaattaaccattttcctgtctgacaccactgcatgggcaaccgggttccatggcacatttagagataaacatagatgtcttgtcttgctcatgtgcagaggagggggtgttggtgtgcaatatagtttctggattccaaattgagttgggggtgctattttcactatggaattaaattactgacattagacagtggacaccgggctatatgtggggatgtctgtggcttgtcatttcctcttagaaggtaatcccccatcttaacttccctttaaattgtgatgcaagccctgggttatttatagaatgattatctaggtttgatagtctgaaggctgggcagagaatgtttgtaatttttattcaccttctttaccccccacgagtatccagttctagaagatctcctgatatcccgggctgccattattcccttgagtgttatagcttcctcttaacttaagcaagagctccaggatgttagcttttttggtggggctggttgtcaggaagaggttccagtgttgtcctttatttttagatgttagctttgtgttgggttagtatgggctgggtattcactagtgaaggcaactaacacagttagacgtgctagttgtgcccactggtgtttatccggtcccaaatgtcaccacagaacacaggaggctggatttggcagcagcacttgtgcttttgttgatttttacccgtgtatcagagttgggggatgctagccaatttagcttcccctccccttaacagggggtctcgcggggtgccaattgtcgcctgccttcccctgcttccccttgttaacttatagcatgataggtaggtcacccaacgtggaagcctggtgggtgatccttcctcggtagggagcgcttagggctgttgagctcaagagccccacctgggtaaaatgtatgttctaaagagttacccaattataacaaaaatgttgtagggtaacgaagacctaatggaagtggtattgttgccgttgaaagacgggtgtcctggctcaagttcgcacttcctatacagtgttaaagccttgtatcggaagtttgggcttcgtcccagtgtactcgataatgtcgactgctgcgaaggtttgggccgtcttccagtaggtgttgggggtccccaatcatgaggttaggcaggtgcacttagctctttagggacccttaagccagacaatgtagtgcccctttttttgcaaattggccttattattaatttcttgttaacactaattctgttctatgaccccgtgttttcagatgccattgggcgtgtcactgagctgaatttggacgcagctacttgacctttgcccccgtgcctccagcgctgataagtgctgcgtccactttgtgttacaggtgggccaaacctccagaatatcaattggtggggccttggtgggctgcataaggcagtaggtttgaggtgacctacttggaccatgtggatccagtgtcctgatcctggaccttgactatgaaacaattctaaaaaaatgcatcatagtccagtgtccagggacagtgcactcggaagtctcatcatctccgtttgtgtgtttagtgtggccagtacggccactcctgtgccacgccctggcatgctgctgacatctgggcgccaatttcagcgggcccttttcccccttgtttaccccatagcaagaagggtaggttacatgggtattttcccatcagcacctgactggccggtgtaattagaggagagggcaacaacgcaaggctgttgttttatttgggttacaagacctgcggcggtcaatgggtttactgattacggtttcctagattgtacagatgaactagaactgtcacaatctatggggtcgtagacagtgtgcttaccagacttccatggaagatgtgaatttgctgctagctatatgggtggcgctatgggctccctagggactcatgtagtggggctttgtgatagctaatgaatgtggcagctgttgtttgtactggaccctgaattggaaacagtaacttggattctgtaacacttcatgggtcccgtagtgacaactatgctgaatatcttgaatatgggaggagggggggctttgggtttcattgtgtgccctttcctgtccaacgtgagggttctagtgttatagggcgtggcagtgtttcttgagggctaatatcacgggtgaggcggttgtcacaggtgctagaccctggagttgaaccagtaccactcggttacaaagtcatggtctagtagttgtgaccctgcaaagctacgtggggatgagcagccagggactttggttgacaagcagacaggcggcgcattggaaccccagaggaatgtcccggggccacctctttggttctgtacatattttgttattgtacataaccatggagttggctgtggtgcactccatctggtaaggggggctggtgcggacgcctgtgtttagtctatgccaatgtttacctgccttgggttactattccaaacgaccacacctttaaggacacctggagccctgatcattctcggcttttactgccacctggcttctgttgggtcagacagtttggtgcgctagttgtgtgcttagcagcaacgcacaccaggctgactgccttagcagtgtggtcctttattgtggcatcctaaggagggattctggagtgcctttcacgtgaagcatgccctgagacgtactcgaggcagtactttaatcgctcatgtgccgctagatgagggagcgccaatttgtacatcctagctctggccatagagttagcccacccttgtgtctccctttggcctctgcggtgccaatttccggtggtttcccttttccgcccgtttatccaatagcatgtaagagaggtttcctagatttggcaactttgagggaacgttccgcgtagctggtgacctaagacccgcccatcaccaccggacagattctgaacttgtcctgtggtgtttggtgtggttttggggtacgcaggagtacgttggaatgctttggagccgagagggatgggcccgcttgtgcgcttatgtgttacacggtgccaataaccggcctggtgcggctgccccgtgacccgtgggccttaccttcctggccatcgggggaccctggtgctagggtcccttgtgttgctttctgccataggggggaaagcatcgccttcagaattggctgctccgttggaacatttgaggcctactgtatccgtgtcctgacaacattccccgcaaacacgacatgggttaatttaaacatgttttgtttgcttgggaatgctcttagggcccggaagcttgtcattggattcatcgtttcctgaactacaggcgtagggcctattgtagcaggcatgtcttcattcctgcgtaccgaatggcatgaaggcacagcctgttaccattggcaccttttttccatgtaaacctccgtgatcccgggtcctttggagactcaagtgtgaatttgttttggtgttcggcgccagggcatcttgacgttggaatgtcaactcaacttgggcacctcgataaccggctcgtggctcgtacagacgattgtttggctctgtaacttgccagggacggctgacgatgtgtttagtctgccacttgcatccggcgctttggttacacgggagactaatggggggtgtggtatggcacaggctgggggtgagtctggggatgtccctgggcgttgctgcagcccattcgccctctggggatgagatgttcaggggtggccggtaccctacgctgccgatttacataatataaattgtaaatgctgcagtagtagggatctggacgcgcgacctgctactcttcggaaacgccaacccaggagcgtcgcctctggccccatactcccgccatgcgactgctcgccccctcccaggcctccctggtgagcccttgccgctccccgcattcctgctttcggcgcccctgcggaccccgatgacagcaggccttcccttcccccgttaatgaaaagaatgacagagaggttgtgacagaaggacagctttattcagtttacagagtgccctcggaggctacgatattcccgttaaatgtcttgttgattctctcaaaggtggggagggaggagctctccacaacaatgttccctggcagcgtgagcgcgcagccctgccgttggatgtatcttctcatgatggtgctgatagaggggtctccggcgtagatgaaaaaggcctgggccatgctctggccggtcacgatcgttatggggttgttggaaatgttccggaccgtcagcttgagggtctggcccggcttccactcctgtgggtagacgtagaagaccgggttggaggagtgggacacgacaacggccgtaatcttggagctcaggggggcctcgtaggtgttgttgtattccagctccgtgatgaaattaggaggaataatcacaggggagccaaagtagcggatgtctgtggattccccgtcccagcgccagtggctcttagggtaggggttgtaatggaaggcaataatcacatcatccaatagggtcatgcccaccttgacgttcagcgggccctctcgtttcaggtccggcgtgtccacggagactcggacgtagcccttaccgcggcgtatggcgttgaccggacacaccttccccgggaatgtgtgaatacgggcgtatgactttagaaatgggggcgtgtgctgcgccagcaggtaaggcaggcactcgtcctggctggtgacgggagagccactgaggaagatctggggctcgctggtgtttagcttgtccccactctgggtgcaggagcgtgtcagctgaatgtcgctctgcccgggcagaatctgcaggtagaggtaggggttcttgaccaatctgatgggcacaatgtaccaggtaaacttccctttctctatgaacaggctgcgcggattcaggacgcttagcacgatgtcctggtcagagtgcataacgaagaagggcttgaggaatacctcgttgtcttccgctccaaagaacaagaacgcaaccgtaaagtagcggctgccgtaggtggtcgtgttgaaggagaaagaaggtaacttgaagctgagtatctggcccaccgaggggcagggaggcagctcttggcactgcgcgtccagctgcaatacctgcttgttggtgacgcgaacgtatgaggggaagatctcgtacttccacacgcctctcatgaacgacgtgtctggtttttcagtgggccgcaggcggcggaggctgttcctgaacgacgagcgccgggacgctagtgctgcatgggctcctccggggtaagcttcggccatggccggagctcgtcgacgggcaaggtgagagttggggggcgggcgacggtgcggccccaatacaactctccgctcgttagctggtagaatatccgcccggcgtctaggttgtcacttcgctcggccggccagaagagcgcaagtccaagtctggtgctggggccgatgtgcagcggtttgtgcccgcagttgtagactgtcatttttatgggcgagtgggcggtccacacgcgcgggcgcagcacccattggtcgcacgccgcctcctggaatgtaaacccccagagagagggcgtgccgccctggagatggccctgtgccatcacatgtatttcctccttgggtggaacgacggcgtcgtgctccgggtggagggggaatagcgtccaggcatctttcagggtcacgagaccggggtccatgcttagaaaacagccctcccgggcggtgggcggcccgggctccagcagaacgtcgcagacccagccctcctcggccctgtccacctgtatgtccaggtgcacggacccggaggctgcgtctcgtgacatggccaggcctggtgccagccgaccacgtcccgtgtcccagccgaggccacgccagagcagagcccgggactgactcagggccacatcccctcggcccgcggacgccgcctcgccagcccccgggccttcatgggcccgctttctacctctctccggcaccccagcctggtcagccgcagaggaagcatgaccttggggtgggacggggcaggcgtgatcctgggcgcaatctttgccgatccccacaccttcactccttgttaggttgatagaatgtcggtaccacgccacggggggcgggcccgcatagggaaaagccagggagagcgatgtgggcgaggatgggctcaggcggccccagacacgcaatttgcccccctgggcggccgcagcctgcccctcggcggcccgtgccccagctccgtcacggggggcgcataggaggggtatatctaggatagccgcacctacacaaatgagacacagacacaggtcatgaggatttaggcaacgcaggcttgtctttatagttacaaacatgggagcgtgcacctggaagatgcagctggggtagatctttacatctttacagggcgcagcagccgccagacactgaagggcagagttcacggcgggcacctcccagagggagcccaccagcccgtacctggccacggccagggcctcgtaggccgagacgggcagccggagcttgtggtactgtccctccggcaggtggagtgggacacagttagagaacattagtcctctggtccctatctccacccgccaggcctgtgtgtcagtttgcagggccatcctcgcactcaggtggactggctaggcacccttctgaagtatctggcggtgactgtcacctggttcttgagagagtccataaaatggctgaagctccaggcgtatagtataatgagcaacagggccaaacaggcggcggggcctgggtagtagcgggcaacgagagactctgtgcaatcaaaccccaggctcccggcctcacccaggaagagcagcggcagggacagcataaaccaggagaaggcgcaaatgagtccggtgaaggtgacgttgcatatcaggcgcggcttccttccgaattttgtgcgcaaaagtttccagatgatgataactgtgaggaggacgatcaggactgccgccagtaggtagcagccggctttcagtccttggacggccgtgtgcatgcctttggtggggccttccctgcacatgttggggcctctgttgagattggcgtcggggcccatggtaatgaggaggatgataatcagcaggagtaccagacaaaacacgcccatcaggtacaggcacacatttctgtgggaggttctcttgggcgttcggctgaacaatgctagggtcttctccaacgccatacccaagtgagtccatacggagcacatcaggcccaagaacatcatgttctgggtcaaaaggcagagaccggtagacgagaactcctgaatcatttttcccagcacccagagcagcagttctatgagaagagctatcagccagacatccattcggtgaaccaattttcttacaaagatgataaacaagatgccagccagtgttagcagaatcagcaggacgagcagcaggcttgtcatgccgctgaggaaggcgctgtaggatttagtgcacgcatcttccgttgcattgacggaagtcatgttggccaccagggtccccacggtggacccgggggccatggtggagagcatcttgctggtcagagccagactgggtggtgtctgcagcaaaagaggaacttgcccaggcagtcagttattttgcatgccacctccctgcctggtggacttccagactattttctgcattcgcccttgcgtgtccattgttgcaaggagcgatttggagaaaataaactgtgagtttcacagatccacgggccacgctcccctgggggcttcatgatcccaccgcctttcccgatgatgatgacaaccgcggctgtctgaagcggctgacgaaatcggttgagattctgatgagaggcttggggggtctttgccctcaaggtgaggctccttctaggaatgccgagccccctgcactagcttcgctccgctggggatctttgccagccttcatactagattcagcgatcccccggttgggaatcttcgccagcccccccgtcctgctatcctgctcgtcgccgcgcctcccatgctaagggcccccttcctttcccttgactttggggatattcggagtctgctctcgccgctctcttctctcgtttaaacgagagaatagtagtagggtccagtctcaggccccctcactttgggtcttagaatggtggccgggctgtaaaattctggaggacggagagggcggccccggagttgttatcaaagaggcactggaggatgttggccgctccttggagcagcttgtcgaaataatgatccacggccacgggaacgccgtgccgctcggcgtaggccgggtcctcggccatctccgtctttctcgcccccttcactccccccttgggctccacaaagacgtactggatgcggtcgtggatctggggcagttcctcgttgcgctcgacgaacttctggtagacggccaggtgaggcatctgggtgctcttgtaggctgagagcttgcggctgagctccgttgaaaagcagagctcccccatggggaccctgccttcacggaggtctgtgtaggcctggtttaggatgtcaatgacgggcaaaaagcccacaggtagcccttgtgtaaatgactcttggaagggccggtgggagaggaggctggccgcctcctttacccgggcatccgccagcaccaggtcgagcacgcgccggcagcgtgtctgcacaaacttgcaggccgtcttccggacgagctccacccccttcatcagggtcttgccgtccgtcagcacccccacatatctcttctttgtaatcagcatcaggcaggagaaggtcttctcggcctccagggagatgggggccacaaacaggctccgggtggtgtgggcggccagggcctcggcaaagcgcagggtctcgctctctgaaaacccccggcactcgataaacagcgagtccgtgtccccgtagatgactcgaagctggccctcggggttgaggggcgcccaggcgtctggggacggggccagggcctgcaggttggcggggctcagggcctccacgaaggccttggcccgctccaacatcgtgcggccctgcagcgtcaccgtctcggcgatggagaggcagggaaagaggccgttggccaccccggtgaagccgtagacggcgttgcacgtgcacttgatggccagctgctgcttgtcgaggatggtcctttggcgcggatcctcgcaggccgccagcagcttcttgatggccttgcgcttggccagccaggaggtcaacagactagccaagaaggactcgtgcacgtgcttctttacaaagtggtagacgccccccgtgagcctgaaggactcatagtcttctcccgggcgcaggccggctagcctgtgctcttctcccggcgttatcatggtagaataacagagattatgagcctgaatgatgctcgggtagaggctggcaaagtccaccaccagaaccggggagttgtagaatccggacaggggctggatgacggtggccccctggtagccgtcccggtcagaggccgagggcatgggcaggataaagttttccttttgggcggccgccaggaggcaggagaacacgcggatctgctgcccatcgtccagcacccgcctgcaggggatgtgagcgatcttggcaatctctgccacctccacgtggatcacgaaatggtttagcagatccatgaccagggccgagtcctgcacgcagtacatgccgagccgcctgcgcccctcggggcccgctgcaaagaggcgaggaatctccttgtaatgcacatcctccttcttggcccccagtaggtgcctggctactgtgtccagcttgtagtctgagaggctgagcttgtcccggcacacggcgtacatgtcgatggggatgaggccggtgatgcggaccttggtgttggcccgcaagaagcccttgcccgcatcatggggtcgcctgacctcgcagacgcccccagccctaattttgcccagagaggctgggttgatgctgtagatgtgcctggctctgtccagaatgtagggccagtcaaagttggccacgttgtagccggtcacaatctccacgctgaggtctctgatgagctggaagaaggcgtagagcatgtccagctccgatgggaactcgtagacctcaaccccctctatgtcttcgcaggtgcccagcgtcagcaggatgcgcctatagcgcccggcctcctcccctgtcgaccagaggacgcaggatatctgcaggatcaggtcagcctcgttggtggccgtggggaagccctcctcccccaaacactcgatatcgaaggccagggcctggtaggagggccaggagctgtcttcacgccggaccgagaggtcgcccacctcacagtcgtactcgagctcggcgtacgagtcccggtgctggaggcgggggatggcgcggcggcagctgtaccagccaaaggtgacaaagtcattgtccaggacaaagcggcgcgtggcatccacgttggcctcaaagatctgacacccgtgcttgtcttgcagccacgtggccacgtgacacacactgttgggatgggagagggtgatcttgtggtagtcgccggcatggttgccgtagcccataatggaacggcgcgtgaccttctccaccgagacccggcagggggtcctgcggtcgaaggtgctggccttgagggcgctgaggactgcaaactccacgtccagaccctgaggcgcgctggcgtagaagtaggcctgctgcccaaacacgttcacacacacgctggccccatcggccttgcgccggcccagtagcttgatgacgatgccgcatggcaccacatacccctgtttatccgatggaatgacggcgcatttctcgtgcgtgtacaccgtctcaagtatgtcgtagacatggaagtctagagggcttccgtgggtgtctgcctccggccttgccgtgccctcttgggcacgctggcgccaccacatgccctttccatcctcgtcaccccccaccaccgtcagggagtcttggtagaaacacagggggggctgaggccctcgcacatccaccacccctgcggcgcctggggtctggaaacacttgggaatgagacgcaggtactccttgtcaggctttttcagaaggcctttattaggtcttaggaaagggttatagaagagtcccccagacatggttaaaactcagtctctgcctccccaagcagtgcggcggcggtctctggatcgtgatagcgtcttctgcgtaggcctggaaaacggtccctggctgcctgcaatgctctgctggccactgagggtccggccgccctctgagctgctctcttttgctcctggttttgctcatgcagcgctaacatgatggcttgtaattctgtcttactaatgggattaatgcctggaccctcaccagaggcatgttgctgagcgagctcgtcgatcccggggtagagcatctgcaccggctgctgcgacatctggcgcgtgcgcctcgtgagggaaataaccaggatcaccacccccaccaccaggaccagaatgagcatgccgccgaaggggtttttgaagaaggagatgaaacccgagaccaggctgctaaacaaaccccccaccgtgctgactaggttggtgatggactgacccacgctacccagactgtccataagttcccccaggccgtccacaaattgatttctgccgtttgacactgcattgtccaaatccttccgcaggccggcgatgttttgcgcctggaagttgtactcccggaagatgccctccaggtcaaagacgttggaggcacgctgttcgtcccgtgagtacagctccagggaggcaaagtcaatgttctcgatgagggaggtgtttagtgagatgaaggtctgcagggtggcaatgccgtccagctcgatggttttaaagtggtggtagtcgttgtagacgtggatctcgttgccggactggaagtagtactggctggtcgcctggcacacctccgtcatcttttttgtaaggaagatctcgttgtcggtgcccagctgtccctcgtaggtcttggtgtcgttgataaagctgaaggacaccagggggcgcgagtagcacatggtctcggagccggggaccctcatgctcttgcgcagggtgacggtggcctggttaacgggcacgcactgggagactgagatgacatcccccaggcgcttggccgccaccgccttaccgtagatgctggacatgacggtggtgggattaatcttggttagttctctcagcaccatgttctgcctcttctgctccaggcaccaggcccgcgcaaggtctcccagcatgcggttgatctggcggcgcagggagtcgtaggcaaattggatctggacggtggcgggattgttgagggtgcccagggacttcccgggggccgcggggggcaccggtgtggtggcattccccgcattccgcctccggcgcctcagaacggcggcggaggtgctcccgcgggccgcgggtggggcggggggcgatggactgctggggggtgaggaagtcggagtggtaagctccgtcaggttcttgacggtggccaacgagcgcggggtcagaggtagccaagctaataacaatcctccgctcgttataaaatatgtaatggcttcctggcccttcgtgtaacgatcctggacggcctcgtacttttcatgcatggtcttgttcacctgctcttcgatgcacttgaaggcgtccgggagctctatgcccacggttgtgttggtcacgaagctagaggtgccctcgtcagtcacaaaatgtattgacttccctgtttctgtggcgatggtcgagtcaaaggtttgccagtgttgaagcgggcagtaggctgtcctgttctcgagcttccaagatagcgtgtaagtgcccttgtccaggaaggctcggcgttcgccttgcgggttcgtccctcggttgtcgtagtccactatcttgtagttagttctcacgtggaaggagtctgcccgctcatggaaggtttccgtatttttcccgtcatagaaaggggacatttccacagtctgcccggtggtggtcacaaagaagtcgaaggggctgttggacttggccatcatgtcagttatcaggcagttgacggtagttcttgttctgtaagtccatatcaaccacccgggggcgtcatagagctccgtctggctggcgtagcggcgcaccccgttggccaggcccccggtgggctttaggttgacggtgatgttaactccgtcgcggtctacatacacgcgcgtcagcccatcttttgtcatctttaccgcgttgtagcactggtagatggtatccatctggtcagtttcgtagctctcaacggagaacttctcctcgtgccggttggtcacggagtccgcgtaccagccattgtagatgagaatgttggtcactatcttggtgtaggagcggaccttaaacgagtagggaataatgttgtctttaaacaccatcaacaggccctccgtgtgattctcccgcgtgccaaacgagggacactggatgtccgaggagaagcggaacaggtcgccgtggctggagagctcgcagactcggaaaggaaagctggtttgctgacgcgtggcggtaggctgcaccgtggtggcggggggcgcgggctgctctggggtctgcgcaccgaggcggcacgccagggcggctagcagcacgaccacgcttagcaccctacgccgagtcatctctcatttggaggtgcaggtagagaagggcatatagatccttaaatacccaccccctgcccttatacagaagaattaggggccggtcagagtcgtacgtgaggtaaagcccatccgggggcagggcctggccggggctgaccgcgtccgcccggcgcaggatcaaggaccgcccccaggtcttgttgtagagggacacggttaggacggcctcgcgcagcgcccggcacagaatttgctggctagatgccagtgagcccccgggtacgctgtagaagctgttgaaggaggtctctatccagtcgctcggctcgatgcctggccatatcagggaagtcaggaacgccttctggtgaggcagcgtacctgcggcgtcacagcagcgagccagggccacgttgctgggtgggggaaagagcccgctctcctccgccaggggccccgtgatgaaggtgtacaggctgtgcgtcagcgcgtgcaggtgctccgagctcagggtctgggtaaacaggtgtgttttgatgtacttggaattctcaaaggcggcaccctcgccggcgcgcctgtcctcccagggacccgagacgaaggcccgtctgtagaggaagtggttgcgcatgcgggccagctcccagtagaccacgtccccccagacgcgcaggcacagggtctcggtcagggtctcgctctgttgcgccaggcaggactgcagcttggccagaccctcggtggccacctggcgcaggtactgctccttgcgcttgagcgcgtccgagagggcgccggacgggccgggctctcgtgccccagccggccggggcacctccgggctctcccgggacgcctcctcctcgcctcggcccaaccgctgcatggctcggttgagccgcgtgtagagctcgttcctcttttgcaggatggcccggtactgggggtgcgccgtgaaggcggcggcgcagtccgccttcagcgcctccaccgcgtcgcccgaggagctgtagaccccgccgcagaagagccgctctgtggccccgggagccacggcatcaaacaggtgagtcagccttgcccccgccagcgcctcctcgcaggcccgccgcaccagggccaggcgacgctcccgggcaaacagggcagagaggcgggaatgtccgccaccctccccctgccccgttgcaccgatagcatggccgccagagttccaatagaggagctccgagagttccgccacctccgggggcactgtcgagaagacgttgtaggtgtccagcgctctggtcgccccctctgcctccggccgccccgggcccgggaccgcgccctcctctgggccgcccggcctcgccttctcctcagcctccaacaggtgcccgagcccagcctgccggacttcattctcaaacagtcccgagaccggctccggattcaccggcaccgccaggtggttacaggagacgtgggtcccctctgccgtggaagggttgccgtggttgggcagaaccatcagctcgcccacacagcgccagcagggcacagaggtgatgtagaggcgcgggtctgggatgggacttacgccccgaaagcggcccagcagatccagggcccgttccaggctctccagccccatggtgtgagacatgcaataaaacacgctattgattctcttcattaaaatctctatgtcatttattaggcacaaacttacatcgactttatgccccccgtaaaactccacagagtacgcgactgagggggtgcggagaggcgggacccgggtaccctttctaccaggggcgagcagcgcggcagaggcctctctcgagttctctagcaggtgcaccagctccagggacagggcgctgcatgcacggtcattctgccgtctcaaacggggaaggaggatggcctccagctcggccagcaggccggcgttgcgcaccaccgcagccacgtccagactcctggggtccagccgggcgcacacgctcagctcaaccgccagggcgtacacctggctgtacgccgccgccagcagccccgacatcgccgccccaggggtctctagacctcgagtccggggagaacggtggccagacggcgcttgcgcctgcccccggagccctgccctcctccacccagcagcagcccggccgaggcctgcgacgcggtgccgaccggctcggccacgctgataaagttgtcctgggctgccccgggcccaccccacactccctccagaaagtcccgagcggcccccgccgtccactctatcccgctggaggcaatggtcgccagggtttctaggacgctgtccgccaggacggagaagcggcccaataagtactccgcgtcgtccctagtcagcgaggcgcatgcctcgcccatggcatccacaaggttgcacaccacatcaaacacacagtcttcctcctgtttttgtgatataatggcctccaggccagccctgatgttctcaatctcatatgtggtcgcggcttgggtccggcgcttcacggtcaaccctagggtgggggtggcaaagacaaacttcttccgcatggaagagcccccggcctgcttgcgcagcccagccccgggggcctgcagcaggttcctgtccacgccccggcccataaagtatcccaggttcccggcctggaatatctggttgttgccgttgacccccgtgtacttgttgatggtcactggcagcgtgacaaccggacgggccttgcagacctggctaagacagtctgtggccgcgcagaccaccgtggtcgcagtaagggaggaggtggcctccgcgtaggccgctgccgactccaccgcccgcgtgcccagtacgtgggggtagtcacgggcgggcaccgactgcgtcctcggcaccagtccctgaatcaggctgatgtagaactgggtctggccgcacgccttcaggatggcgttgttgagcctctgcttggcgtaagtgaccaggttgccaggcaccacatctatgacgttgctctcttcgtgggcccgggagcccccgtccacaaagagggccaggtcagagtactcctccgcgctggccccgctggggacagggaccgagcgccgcctggaaaagttgtgccacaggtacaggcttgagagcttagtgtccgggaatagggtcttgtggtaggtgttgaggaatttcatgtagggcccgttgatgatgtagttctccctcctggtagtggacttgatgaagctgttctggagggcggcgttctcccccgtgaagaccaccctgttcttgatcttgatgttcctggggcacagcatcagcaccttggacatgcgcaccggcagccgccggccgtacacccggccctgcagggccgcgtcgaggtctggcaggtcgcaggtgggctccccatgcaccaccttggcctccttggccgtgaggacccccttgtcgatggccaggctcctaaagttggtgcacagcgtctggtagtgaccctttagccactctggggggctctggccaagcccggggttgtcattctcatagcacatacagatgggcagggagatgtcctgcaggatggtcagcagtgagcggtaaaacaactgggtgaagacggggcaggcgggctgcgcaaaggggttgcacgagtactgcatcacgtggtagcagctcttgaccaggtccttgtaggtgatgttgttcttggccatgctgttcataaactggaccacttcggcgtccaccgccgcatccacgtccttgaacatcttgacaaagtcacgcgggccatggggctccttctctagctttccctcagcgtctatgcccagccgagacagccgctccagcaggttctggttcagctgccagtaggtgtagcggggctcgtcgtccggccgctgcccgtcgtcctccttatcgatgaagttgagaaagttgcccaaaaagtccgtctcgttgtaggagcccgaggcccccgagatcacataggggtccctccgctgcgtggacatgacgggggggaagcggtccctcagcctaaagaagagcgtgttcaggcacacggccggggcccggccctcgcagagcgagcacatggggctggcggccgcccccgccacgtagctgcccgtctccggcaccggggtcagagagctcttctgtccctggcaaaactgcaggtagtaggcatagcgggcaagaaggttgggcgagaaggaggccgcatagaccaggtgctccaccgcgtagtttcccggaccgttggttccggtcacgtctggcccaccccagcccgagaagcagggtcggcggcaggggtcccaggtcccctcctgcagggtccccaggccgtgggtcatgtagaaactgttaaagagactctccttgccctgaccggttgacttcgagacccccgagacgtaaaggacggaattggtggcaaagatctgcgtggacacgtggggggccaggctggcattatatcggtgtaacgcagccatacgggcctctgggccctcacagtcggcaaacaggggccaagagtcgtagttgaggcttgccggggtctcgtgcgaggcctccagcatggcgggcgcgtaactcaccgccagctcgcaggccgcgctgtccacaatcattaaggctcccgagtccgggtgactgatggttgaggctgggaactccttgaggggggccaccttggccaccttggcctggtcctgcaggctctgcttctccagcagctctaccagcttgcccacccgccggacgcgcagcgcctgcgccagcccggtgtacagcgcctcgtgcatgcagcggctgaggtccgagttgtaaaactggcggagctggggcacgccctctgggaacacctccttgtcgtagagcgggaccctaacgctcgcagactgccccaccgctacctcctgttttaacgatggaatggccaccaggtttccgctgtagagtcgctccttgaaggcctcggttattgccaccgcccccaggtaggcagagggatctagcccttcggggaagaagtcccccggcttggagctttctctcggtagggcgctgtaggcgtcgtacccaaacacctccctggtctcgccacagagggcctcgagacccggcccctcaaagatggggggaaccatatgggcattgtggaacacgtagatgtccctgtgataggaggtagcgcgtaggagcccgcagttggggtcgggcctcctgtgcagagccttgacattgatgctgaagcccggctccacggtgatgccgcaaaggagcggcaccgtcaggcacctgtggcccgcgtagccggtccccagtgtggccacctccctaagagggtaggtggccagggggtaaaagtagatgtagccgcacggacccggctggctctggctgcccagattatcctcgctagtctgtgcaccctgcatgatgcccaaggtatcgccccggcctcccagtcccacattaaatgttacactttactcatcacgcaacacccactgtttattcatttacaaagatttcaggaagtcagtcaggctggccagggcccacgtcacggggaactgacgtctcagcgatcttggcatgccgcccagcctcgcaaaccagagtctgcgatagagggccaggtagtgggcgattgcccccagcacgaaggcggcgctcttgtggtcatccaggtagtttcgcaccgcaaacaccactgtgtagcacagcaccaccctgagccgcgaccagtagtcgtagtggtcgttgtacactgcgcgcaggacgctgatgatgagccgtacgtgcgtgtctttgcccccgatgtcggctgtcctgcaggccagctctgcgtacagcttcctatccttcctcagggaggccttgatgagccggcagaggaccagggctggcaaaggcaggtctttctcatcccgggtgaacaccgcgtacatggccctgaacatgaggtagctggactcagccaccttgtcgtccggcggcgagggcgcgacccacgcctcgaccggggtcttcacaaacacagaatctgtagacttggctggcctcatggtctcgtcaggccagctcacgggcttcaggcttatatgataaaatgggcgtggcagaatagtataagacgcgaggcctgggtgaggagagtccagagcaatggccaggttcatcgctcagctcctcctgttggcctcctgcgtggccgccggccaggctgtcaccgctttcttgggtgagcgagtcaccctgacctcctactggaggagggtgagcctcggtccagagattgaggtcagctggtttaaactgggcccaggagaggagcaggtgcttattgggcgcatgcaccacgatgtcatctttatagagtggcctttcaggggcttctttgatatccacagaagtgccaacaccttctttttagtagtcaccgctgccaacatctcccatgacggcaactacctgtgccgcatgaaactgggcgagaccgaggtcaccaagcaggaacacctgagcgtggtgaagcctctaacgctgtctgtccactccgaaaggtctcagttcccagacttctctgtccttactgtgacatgcaccgtgaatgcatttccccatccccacgtccagtggctcatgcccgagggcgtggagcccgcaccaactgcggcaaatggcggtgttatgaaggaaaaggatgggagcctctctgttgctgttgacctgtcacttcccaagccctggcacctgccagtgacctgcgttgggaaaaatgacaaggaggaagcccacggggtttatgtttctggatacttgtcgcaataaacgcacttgcctatttcaccttgttttagtgtggcattggggggtggcattgcgggtggatagcctcgcgactcgtgggaaaatgggcggaagggcaccgtgggaaaatagttccaggtgacagcagcagtgtgtgaagattgtcacagctgctggtttggagaaaacgggggtgggcggtgatcagggagaacaattccccggggacacctgcacgagacccctgggctctcaggaactccgcccaggtctcgccaattggggtgatcctgtagcgccgcggtttcagcatcacaggttattttgcctgaagcttgctggggcgtaaatccctctcgccttgtttctcagagagcatttcaggccggttttgcagtcgctgctgcagctatggggtccctagaaatggtgccaatgggcgcgggtccccctagccccggcggggatccggatggggacgatggcggaaacaactcccaatatccatctgcttctggctcttctgggaacacccccaccccaccgaacgatgaggaacgtgaatctaatgaagagcccccaccgccttatgaggacccatattggggcaatggcgaccgtcactcggactatcaaccactaggaacccaagatcaaagtctgtacttgggattgcaacacgacgggaatgacgggctccctccccctccctactctccacgggatgactcatctcaacacatatatgaagaagcgggcagaggaaggtaagagtgccatctatctgtacttttatttattgcatcacaagtcacatcaataataagggcgccatctagcgggagatgttatccacaccatcccaattcacatctcagggacaacaggtcaaagttctttgttgacacccccagcgctggctccagggggtggcagcgttggatgcagtcctccgcatcggggcggacgcctcctcccaacgcgtttctgcggatcagtcgctggctggtgggcatcggagtcggtgggcggtcctccacggggacacgctccttcttggccttgttctttgaccttttggacattcttctgaaggaacggcggagagtagcgtagaatccagccagtggtctacccggtcgcatggtggcttcttagatgaggagcaggcataaaagtccaaacaggacacagagtaccaccaggagtagtcttagtctgctgacgtctgggtcctcggggcaggggtggctaggcctggtctccgtagaagagccgggcaggccgcaggcagaggactgctgctctagcaaagcacgctccaggacgtgtaccatctcgagagtgaggcacagctgttttcgtggacttttatacagtaaggacaaggaaagaaggccagaggaatgtggaaagatgagcgaggacaggtgtggaggttttgggctagctcttagtttctgggtgtgagagagggattaaagtgcttatgcgcaaagaatgtgtcaacaacaggtgttcctgcctctgctggcatgagttaggtgtggcttgggctgaatccaaatgtgtattggcacaagatggaaagcaaagttgctggagttactgggtgggagacagggatgtatgtggtcccccgctggtatgccagtaccctgtggaagtaaggggcctcatctgcccggtagttgtgttgtgcagaggtctgatgtgtgtaggaggggtgggttcaacgcaggggcgttggtggcggagtctggcaacgcccgggtccttgctacctgtgtggtgtgtgaagggctgggtaaaggtgtctgccaattctcgcatgtcctcctttccccttgttttgaaatagaatatgaatgtggcttttcagcctagacagacagtgtggctaagggagtgtgtgccagttaaggtgattagctaaggcattcccagtaaatggagggagagtcagtcaggcaagcctatgacatggtaatgcctagaagtaaagaaaggttagtcatagtagcttagctgaactgggccgtgggggtcgtcatcatctccaccggaaccagaagtacccaaaagcagcgtaggaaggtgtggatcaccgccgccaccgtctgtcatcgaaggcgggtcccggtcacctcctttgttttcaacctcttccgtcaaatttggagggcctccatcatttccagcagagtcgctagggttatgaggcagcgggtcatgtgggccattgtcatcagtgttgtcagggtcctgtgggccattgtcatcagtgttgtcagggtcctgaggcagcgggtcatgtgggccattgtcatcagtgttgtcagggtcctgtgggccattgtcatcagtgttgtcagggtcctgtgggccattgtcaggaccacctccaggtgcgcctaggttttgagagcagagtgggggtccgtcgccggccccactcacgagcaggtggtgtctgccctcgttggagttagagtcagattcatggctagaatcgtcggtagcttgttgagggtgcgggagggagtcatcgtggtggtgttcatcagtgtgtcgtggtccatgataatacatccagattaaaatggccataaacaggaggagccaaaggagatcaaccaatagagtccaccagttttgttgtagatagagagcaataataagcaggatgatggctaggaagaaggctaggatgaaggccaaaagctgccagatggtggcaccaagccgccagagaatctccaagaagtagatccagagacctaagactgcgttgaaaaaaagagtgttagggctggaaaggtgagggtgtggtaaataagtcctagggaatgttagatcttaccaagtaagcagccaaagatgaacagcacaattccaaggtacaatgcctgtccgtgcaaattccagagagcgatgagtaggagggtgactggggaaagaggagaaagtgcgttagagaaggaagcgtaagggaaagggggtggggggcaaagggtgtaatacttactcatcagtaggagtagaccaaggcctccaagtggacagagaaggtctcttctgaagataaagatgatgagaatgataataataagcatgagagcaaaggaatagaggacaaggagcgctcctccagtccagttactcataacgatatacagccagaacagtagcgccaagagcaggagaaggagagcaaggcctatggaagaggagagggggggtcctagagggggccgtggcgggcccggtgggcccctctcaaggtcgcgttccatggtcagggtagtgtggcaggagcaaggcaactgaggaaagaagctgacagagcagtgacagaggcttatgtaggccgcctacgagagagcaacgcgtgtttctggggatggaggcccggggggatttgcggggtctgccggaggcagtacgggcgccgctttcccgaaagcggcgtagtgtgtgtgcatgtaagcgttaaaagaggaagtagaaagcgtgtgtttgtgttagaaaagcgagtccccgaggggcaagctgtgggaatgcggtggtaaagcgtagcaggaaatggaaaggcagtgcggcaatcacaagggggagtgagcagtgttgtgggaagcggcagtgtaatccacacaaagaggcgtagggcgcgcaacgttgggaggtcgttgtcggcaggcgggaggctgtgctttaggggggttcaggtgaggcaaggctgtggggtaaccgtaggggaggcgggtgaggcggctaagagggctaagggtcggcgggtgacgaagcagcagacgggggatatgggaatttcagaatgaggtggcggattccggcgaaaagggtgtgggctgtgcaagtgtcatgaggcaggcgcggaaagtcgctgcggcttgctggcgtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatgg

The invention claimed is:

1. A preparation of Epstein-Barr virus-like particles (EB-VLPs) substantially free of Epstein-Barr Virus (EBV) DNA, wherein said EB-VLPs were generated from EBV lacking at least one functional gene selected from the group consisting of the BFLF1 gene, the BBRF1 gene, the BGRF1 gene, the BDRF1 gene, the BALF3 gene, and the BFRF1A gene; wherein, in the EB-VLPs substantially free of EBV DNA, the number of EBV DNA-free VLPs produced from said EBV lacking said at least one functional gene is increased as compared to VLPs produced from an EBV mutant strain in which the terminal repeats have been deleted (ΔTR-EBV).

2. The preparation of EB-VLPs of claim 1, wherein said EB-VLPs further comprise at least one artificial polypeptide.

3. The preparation of EB-VLPs of claim 1, wherein said EB-VLPs lack at least one additional non-essential EBV polypeptide.

4. A pharmaceutical composition comprising:
(a) a preparation of EB-VLPs according to claim 1, and
(b) at least one pharmaceutically acceptable carrier and/or excipient.

5. The pharmaceutical composition of claim 4, wherein the pharmaceutical composition is an immunogenic composition.

6. A polynucleotide comprising an Epstein-Barr virus (EBV) genome, wherein the polynucleotide is stably or transiently expressed in a suitable host cell, and wherein the polynucleotide:
(a) lacks at least one expressible gene selected from the group consisting of the BFLF1 gene, the BBRF1 gene, the BGRF1 gene, the BDRF1 gene, the BALF3 gene, and the BFRF1A gene, and
(b) is capable of producing the EB-VLP of claim 1.

7. The polynucleotide of claim 6, additionally lacking at least one expressible latent gene.

8. A vector comprising the polynucleotide of claim 6.

9. An isolated host cell comprising the polynucleotide of claim 6.

10. A method for manufacturing EB-VLPs substantially free of EBV DNA, comprising the steps of:
(a) culturing a suitable isolated host cell, wherein said cell comprises the polynucleotide of claim 6 or a vector comprising the polynucleotide of claim 6, and
(b) obtaining EB-VLPs substantially free of EBV DNA from the cells.

11. The method of claim 10, wherein said EB-VLPs are obtained from the supernatant of the cultured cells.

12. The method of claim 10, further comprising the step of expressing at least one gene coding for an artificial polypeptide in said host cell during step (a).

13. A method for the manufacture of a vaccine comprising the steps of the method of claim 10, and the further step of formulating the EB-VLPs as a vaccine.

14. A vaccine comprising EB-VLPs substantially free of EBV DNA obtainable by the method according to claim 13.

15. A composition comprising Epstein-Barr virus like particles (EB-VLPs) substantially free of EBV DNA obtained by the method according to claim 10.

16. The preparation of EB-VLPs of claim 1, wherein the number of EBV DNA containing VLPs is determined by infecting Raji cells and determining the number of Raji cells containing EBV DNA.

17. The preparation of EB-VLPs of claim 3, wherein said additional non-essential EBV polypeptide is the BNRF1 polypeptide.

* * * * *